(12) United States Patent
Kapeller-Libermann et al.

(10) Patent No.: US 7,696,316 B2
(45) Date of Patent: Apr. 13, 2010

(54) 21910, 56634, 55053, 2504, 15977, 14760, 25501, 17903, 3700, 21529, 26176, 26343, 56638, 18610, 33217, 21967, H1983, M1983, 38555 OR 593 MOLECULES AND USES THEREFOR

(75) Inventors: Rosana Kapeller-Libermann, Chestnut Hill, MA (US); John Joseph Hunter, Somerville, MA (US); Rachel E. Meyers, Newton, MA (US); Laura A. Rudolph-Owen, Medford, MA (US); Rory A. J. Curtis, Framingham, MA (US); Peter J. Olandt, Newton, MA (US); Fong-Ying Tsai, Newton, MA (US); Katherine M. Galvin, Jamaica Plain, MA (US); Miyoung Chun, Belmont, MA (US); Mark J. Williamson, Saugus, MA (US); Inmaculada Silos-Santiago, Del Mar, CA (US); Rajasekhar Bandaru, Watertown, MA (US)

(73) Assignee: Millennium Pharmaceuticals, Inc., Cambridge, MA (US)

( * ) Notice: Subject to any disclaimer, the term of this patent is extended or adjusted under 35 U.S.C. 154(b) by 295 days.

(21) Appl. No.: 11/583,766

(22) Filed: Oct. 19, 2006

(65) Prior Publication Data

US 2007/0037203 A1 Feb. 15, 2007

Related U.S. Application Data

(60) Continuation of application No. 10/423,543, filed on Apr. 25, 2003, now abandoned, which is a continuation-in-part of application No. 10/278,036, filed on Oct. 22, 2002, now abandoned, which is a continuation of application No. 09/711,216, filed on Nov. 9, 2000, now abandoned, said application No. 10/423,543 is a continuation-in-part of application No. 10/012,055, filed on Nov. 13, 2001, now abandoned, said application No. 10/423,543 is a continuation-in-part of application No. 10/003,690, filed on Nov. 15, 2001, now Pat. No. 6,787,345, said application No. 10/423,543 is a continuation-in-part of application No. 09/797,039, filed on Feb. 28, 2001, now Pat. No. 6,730,491, said application No. 10/423,543 is a continuation-in-part of application No. 10/217,168, filed on Aug. 12, 2002, now Pat. No. 6,929,938, said application No. 10/423,543 is a continuation-in-part of application No. 09/929,218, filed on Aug. 14, 2001, now abandoned, said application No. 10/423,543 is a continuation-in-part of application No. 09/963,159, filed on Sep. 25, 2001, now abandoned, said application No. 10/423,543 is a continuation-in-part of application No. 10/121,911, filed on Apr. 12, 2002, now Pat. No. 6,607,892, which is a division of application No. 09/412,210, filed on Oct. 5, 1999, now Pat. No. 6,403,358, said application No. 10/423,543 is a continuation-in-part of application No. 10/105,989, filed on Mar. 25, 2002, now abandoned, which is a continuation of application No. 09/392,189, filed on Sep. 9, 1999, now abandoned, said application No. 10/423,543 is a continuation-in-part of application No. 10/336,153, filed on Jan. 3, 2003, now abandoned, which is a continuation of application No. 09/845,044, filed on Apr. 27, 2001, now abandoned, said application No. 10/423,543 is a continuation-in-part of application No. 09/928,531, filed on Aug. 13, 2001, now abandoned, said application No. 10/423,543 is a continuation-in-part of application No. 09/920,346, filed on Jul. 31, 2001, now abandoned, said application No. 10/423,543 is a continuation-in-part of application No. 10/008,016, filed on Nov. 8, 2001, now abandoned, said application No. 10/423,543 is a continuation-in-part of application No. 09/909,743, filed on Jul. 20, 2001, now abandoned, which is a division of application No. 09/448,076, filed on Nov. 23, 1999, now Pat. No. 6,300,092, which is a continuation-in-part of application No. 09/276,400, filed on Mar. 25, 1999, now Pat. No. 6,140,056, said application No. 10/423,543 is a continuation-in-part of application No. 10/336,489, filed on Jan. 2, 2003, now abandoned, which is a continuation of application No. 09/608,921, filed on Jun. 30, 2000, now abandoned, which is a continuation-in-part of application No. 09/163,821, filed on Sep. 30, 1998, now abandoned, said application No. 10/423,543 is a continuation-in-part of application No. 10/060,763, filed on Jan. 30, 2002, now abandoned, which is a continuation of application No. 09/365,162, filed on Jul. 30, 1999, now abandoned.

(60) Provisional application No. 60/205,447, filed on May 19, 2000, provisional application No. 60/248,325, filed on Nov. 14, 2000, provisional application No. 60/248,893, filed on Nov. 15, 2000, provisional application No. 60/186,061, filed on Feb. 29, 2000, provisional application No. 60/312,539, filed on Aug. 15, 2001, provisional application No. 60/257,511, filed on Dec. 22, 2000, provisional application No. 60/234,922, filed on Sep. 25, 2000, provisional application No. 60/200,688, filed on Apr. 28, 2000, provisional application No. 60/235,035, filed on Sep. 25, 2000, provisional application No. 60/221,925, filed on Jul. 31, 2000, provisional application No. 60/260,166, filed on Jan. 5, 2001, provisional application No. 60/246,669, filed on Nov. 8, 2000, provisional application No. 60/117,580, filed on Jan. 27, 1999.

(51) Int. Cl.
| | |
|---|---|
| *C07K 14/00* | (2006.01) |
| *C07H 21/04* | (2006.01) |
| *C12P 21/04* | (2006.01) |
| *C12P 21/06* | (2006.01) |

(52) U.S. Cl. .................. 530/350; 435/6; 435/69.1; 435/69.7; 435/320.1; 435/325; 536/23.5; 536/23.7

(58) Field of Classification Search .............. None
See application file for complete search history.

(56) References Cited

U.S. PATENT DOCUMENTS

| | | | |
|---|---|---|---|
| 5,194,596 A * | 3/1993 | Tischer et al. | 530/399 |
| 6,313,267 B1 * | 11/2001 | Hitomi et al. | 530/350 |
| 6,403,358 B1 * | 6/2002 | Kapeller-Libermann et al. | 435/232 |
| 6,514,719 B1 * | 2/2003 | Bird et al. | 435/15 |
| 2002/0077312 A1 * | 6/2002 | Curtis et al. | 514/44 |
| 2004/0258678 A1 * | 12/2004 | Bodary et al. | 424/130.1 |

FOREIGN PATENT DOCUMENTS

| | | | |
|---|---|---|---|
| EP | 1130094 | | 5/2001 |
| EP | 1130094 | * | 11/2001 |
| EP | 1396543 A2 | | 3/2004 |
| WO | WO 96/08260 | | 3/1996 |
| WO | WO 99/01547 | | 1/1999 |
| WO | WO 01/12659 A2 | | 2/2001 |
| WO | WO 01/12670 A1 | | 2/2001 |
| WO | WO0112659 | * | 2/2001 |
| WO | WO 01/96547 A2 | | 12/2001 |
| WO | WO02/33100 | * | 4/2002 |

OTHER PUBLICATIONS

Ngo, et al, The Protein Folding Problem and tertiary Structure Prediction, 1994, Merz, et al. (ed.), Birkhauser, Boston, MA.*

Ngo, et al, The Protein Folding Problem and tertiary Structure Prediction, 1994, Merz, et al. (ed.), Birkhauser, Boston, MA, pp. 492-495.*

Bork ,2000, Genome Research 10:398-400.*

Bork et al 1996, Trends in Genetics 12:425-427.*

Legembre et al., "NUAK family, SNF1-like kinase, 2 [*Homo sapiens*]," Sep. 24, 2005, (sequence) GenBank [online] Bethesda, MD, USA: National Center for Biotechnology Information [retrieved on Oct. 11, 2005]. Retrieved from the Internet: URL: http://www.ncbi.nlm.nih.gov/>. GenPept Accession No. NP_112214.

Legembre et al., "Identification of SNF1/AMP Kinase-Related Kinase as an NF-kB-regulated Anti-Apoptotic Kinase Involved in CD95-induced Motility and Invasiveness," Journal of Biological Chemistry, vol. 279(45), pp. 46742-46747, (Nov. 5, 2004).

Bork, P., "Powers and Pitfalls in Sequence Analysis: The 70% Hurdle," Genome Research, vol. 10, pp. 398-400, (2000).

Bork, P., "Go Hunting in Sequence Databases But Watch Out for the Traps," Trends in Genetics, vol. 12, No. 10, pp. 425-427, (Oct. 1996).

Ngo et al., "The Protein Folding Problem and Tertiary Structure Prediction," Merz et al (ed.), Birkhauser, Boston, MA , pp. 492-495, (1994).

BLAST Homology Searches Against PATENT, NRP, DBEST, and NRN databases.

Gao B. et al., "Adenylate Cyclase, Type IV (ATP Pyrophosphate-Lyase) (Adenylyl Cyclase)," Aug. 1, 1992, (sequence) GenBank [online] Bethesda, MD, USA: National Center for Biotechnology Information. Retrieved from the Internet: URL: http://www.ncbi.nlm.nih.gov/>. SwissProt Accession. No. P26770.

Stengel D. et al., "Adenylate Cyclase, Type II (ATP Pyrophosphate-Lyase) (Adenylyl Cyclase)," Oct. 1, 1994, (sequence) GenBank [online] Bethesda, MD, USA: National Center for Biotechnology Information. Retrieved from the Internet: URL: http://www.ncbi.nlm.nih.gov/>. SwissProt Accession No. Q08462.

Villacres, E.C. et al., "Adenylate Cyclase, Type I (ATP Pyrophosphate-Lyase) (Adenylyl Cyclase)," Oct. 1, 1994, (sequence) GenBank [online] Bethesda, MD, USA: National Center for Biotechnology Information. Retrieved from the Internet: URL: http://www.ncbi.nlm.nlh.gov/>. SwissProt Accession No. Q08828.

Chabardes, D. et al., "Localization of mRNAs Encoding $Ca^{2+}$—Inhibitable Adenylyl Cyclases Along the Renal Tubule," Journal of Biological Chemistry., vol. 271, No. 32, pp. 19264-19271, (Aug. 1996).

Cooper, D.M. et al., PubMed Abstract, "Adenylyl Cyclases and the Interaction Between Calcium and CAMP Signalling," Nature., vol. 374, No. 6521, pp. 421-424, (Mar. 30, 1995).

Stevens, T. et al., PubMed Abstract, "Ca(2+)—Inhibitable Adenylyl Cyclase Modulates Pulmonary Artery Endothelial Cell cAMP Content and Barrier Function," Proc. Natl. Acad. Sci. USA., vol. 92, No. 7, pp. 2696-2700, (Mar. 28, 1995).

Gao, B.N. et al., PubMed Abstract, "Cloning and Expression of a Widely Distributed (Type IV) Adenylyl Cyclase," Proc. Natl. Acad. Sci. USA., vol. 88, No. 22, pp. 10178-10182, (Nov. 15, 1991).

Warner, D.R. et al., PubMed Abstract, "Cell-Free Synthesis of Functional Type IV Adenlyl Cyclase, Anal Biochem ," Proc. Natl. Acad. Sci. USA., vol. 232, No. 1, pp. 31-36, (Nov. 20, 1995).

Hillier, L. et al., "The WashU-Merck EST Project," Aug. 30, 1995, (sequence) GenBank [online] Bethesda, MD, USA: National Center for Biotechnology Information. Retrieved from the Internet: URL: http://www.ncbi.nlm.nih.gov/>. SwissProt Accession No. R94561 and BLAST Homology.

Hillier, L. et al., "The WashU-Merck EST Project," Aug. 30, 1995, (sequence) GenBank [online] Bethesda, MD, USA: National Center for Biotechnology Information. Retrieved from the Internet: URL: http://www.ncbi.nlm.nih.gov/>. SwissProt Accession No. R94560.

Hillier, L. et al., "The WashU-Merck EST Project," Sep. 5, 1996, (sequence) GenBank Bethesda, MD, USA: National Center for Biotechnology Information. Retrieved from the Internet: URL: http://www.ncbi.nlm.nih.gov/>. EMBL Accession No. AA044876.

Hillier, L. et al., "The WashU-Merck EST Project," Jun. 14, 1996, (sequence) GenBank [online] Bethesda, MD, USA: National Center for Biotechnology Information. Retrieved from the Internet: URL: http://www.ncbi.nlm.nih.gov/>. EMBL Accession No. W69778.

Woessner, J. et al., "*Homo sapiens* Full Length Insert cDNA Clone ZD90F02," Aug. 30, 1998, (sequence) GenBank [online] Bethesda, MD, USA: National Center for Biotechnology Information. Retrieved from the Internet: URL: http://www.ncbi.nlm.nih.gov/>. EMBL Accession No. AF088070.

Strausberg, R., "National Cancer Institute/National Institute of Neurological Disorders and Stroke, Brain Tumor Genome Anatomy Project (CGAP/BTGAP), Tumor Gene Index," Feb. 10, 1999, (sequence) GenBank [online] Bethesda, MD, USA: National Center for Biotechnology Infomation. Retrieved from the Internet: URL: http://www.ncbi.nlm.nih.gov/>. GenBank Accession No. AI421810.

Hillier, L. et al., "The WashU-Merck EST Project," Sep. 5, 1996, (sequence) GenBank [online] Bethesda, MD, USA: National Center for Biotechnology Information. Retrieved from the Internet: URL: http://www.ncbi.nlm.nih.gov/>. GenBank Accession No. AA044828.

Legembre et al., "Identification of SNF1/AMP Kinase-Related Kinase as an NF-kB-regulated Anti-Apoptotic Kinase Involved in CD95-induced Motility and Invasiveness," J. Biol. Chem., vol. 279(45), pp. 46742-46747, (Nov. 5, 2004).

Swiss—Prot Entry P26770.

Swiss—Prot Entry Q08462.

Swiss—Prot Entry Q08828.

Chabardes, D. et al., *Localization of mRNAs Encoding $Ca^{2+}$-Inhibitable Adenylyl Cyclases Along the Renal Tubule*, The Journal of Biological Chemistry, vol. 271, No. 32, Aug. 1996, pp. 19264-19271.

Cooper, D.M., et al., PubMed Abstract, *Adenylyl Cyclases and the Interaction Between Calcium and cAMP Signaling*, Nature Mar. 30, 1995;374(6521):421-4.

Stevens, T. et al., PubMed Abstract, *Ca(2+)-Inhibitable Adenylyl Cyclase Modulates Pulmonary Artery Endothelial Cell cAMP Content and Barrier Function*, Proc Natl Acad Sci USA Mar. 28, 1995;92(7):2696-700.

Gao, B.N. et al., PubMed Abstract, *Cloning and Expression of a Widely Distributed (Type IV) Adenylyl Cyclase*, Proc Natl Acad Sci USA Nov. 15, 1991;88(22):10178-82.

Warner, D.R. et al., PubMed Abstract, *Cell-Free Synthesis of Functional Type IV Adenylyl Cyclase*, Anal Biochem Nov. 20, 1995;232(1);31-6.

Swiss—Prot Entry R94561 and BLAST Homology.

Swiss—Prot Entry R94560.

Hillier et al., EMBL Accession No. AA044876.

Hillier et al., EMBL Accession No. W69778.

Woessner et al., EMBL Accession No. AF088070.
Strausberg et al. GenBank accession AI421810 (Mar. 30, 1999).
Hillier et al. GenBank accession AA044828 (Sep. 5, 1996).

* cited by examiner

*Primary Examiner*—Robert B Mondesi
*Assistant Examiner*—Padma V Baskar

(57) ABSTRACT

The invention provides isolated nucleic acids molecules, designated 21910, 56634, 55053, 2504, 15977, 14760, 25501, 17903, 3700, 21529, 26176, 26343, 56638, 18610, 33217, 21967, h1983, m1983, 38555 and 593 nucleic acid molecules. The invention also provides antisense nucleic acid molecules, recombinant expression vectors containing 21910, 56634, 55053, 2504, 15977, 14760, 25501, 17903, 3700, 21529, 26176, 26343, 56638, 18610, 33217, 21967, h1983, m1983, 38555 and 593 nucleic acid molecules, host cells into which the expression vectors have been introduced, and nonhuman transgenic animals in which a 21910, 56634, 55053, 2504, 15977, 14760, 25501, 17903, 3700, 21529, 26176, 26343, 56638, 18610, 33217, 21967, h1983, m1983, 38555 or 593 gene has been introduced or disrupted. The invention still further provides isolated 21910, 56634, 55053, 2504, 15977, 14760, 25501, 17903, 3700, 21529, 26176, 26343, 56638, 18610, 33217, 21967, h1983, m1983, 38555 or 593 proteins, fusion proteins, antigenic peptides and anti-21910, 56634, 55053, 2504, 15977, 14760, 25501, 17903, 3700, 21529, 26176, 26343, 56638, 18610, 33217, 21967, h1983, m1983, 38555 or 593 antibodies. Diagnostic and therapeutic methods utilizing compositions of the invention are also provided.

14 Claims, No Drawings

21910, 56634, 55053, 2504, 15977, 14760, 25501, 17903, 3700, 21529, 26176, 26343, 56638, 18610, 33217, 21967, H1983, M1983, 38555 OR 593 MOLECULES AND USES THEREFOR

RELATED APPLICATIONS

The present application is a continuation of U.S. patent application Ser. No. 10/423,543, filed Apr. 25, 2003 (abandoned), which is a continuation-in-part of U.S. patent application Ser. No. 10/278,036, filed Oct. 22, 2002 (abandoned), which is a continuation of U.S. patent application Ser. No. 09/711,216, filed Nov. 9, 2000 (abandoned), which claims the benefit of U.S. Provisional Application Ser. No. 60/205,447, filed May 19, 2000 (abandoned). U.S. patent application Ser. No. 10/423,543 is also a continuation-in-part of U.S. patent application Ser. No. 10/012,055, filed Nov. 13, 2001 (abandoned), which claims the benefit of U.S. Provisional Application Ser. No. 60/248,325, filed Nov. 14, 2000 (abandoned). U.S. patent application Ser. No. 10/423,543 is also a continuation-in-part of U.S. patent application Ser. No. 10/003,690, filed Nov. 15, 2001, now U.S. Pat. No. 6,787,345, which claims the benefit of U.S. Provisional Application Ser. No. 60/248,893, filed Nov. 15, 2000 (abandoned). U.S. patent application Ser. No. 10/423,543 is also a continuation-in-part of U.S. patent application Ser. No. 09/797,039, filed Feb. 28, 2001, now U.S. Pat. No. 6,730,491, which claims the benefit of U.S. Provisional Application Ser. No. 60/186,061, filed Feb. 29, 2000 (abandoned). U.S. patent application Ser. No. 10/423,543 is also a continuation-in-part of U.S. patent application Ser. No. 10/217,168, filed Aug. 12, 2002, now U.S. Pat. No. 6,929,938, which claims the benefit of U.S. Provisional Application Ser. No. 60/312,539, filed Aug. 15, 2001 (abandoned). U.S. patent application Ser. No. 10/423,543 is also a continuation-in-part of U.S. patent application Ser. No. 09/929,218, filed Aug. 14, 2001 (abandoned), which claims the benefit of U.S. Provisional Application Ser. No. 60/257,511, filed Dec. 22, 2000 (abandoned). U.S. patent application Ser. No. 10/423,543 is also a continuation-in-part of U.S. patent application Ser. No. 09/963,159, filed Sep. 25, 2001 (abandoned), which claims the benefit of U.S. Provisional Application Ser. No. 60/234,922, filed Sep. 25, 2000 (abandoned). U.S. patent application Ser. No. 10/423,543 is also a continuation-in-part of U.S. patent application Ser. No. 10/121,911, filed Apr. 12, 2002, now U.S. Pat. No. 6,607,892, which is a divisional of U.S. patent application Ser. No. 09/412,210, filed Oct. 5, 1999, now U.S. Pat. No. 6,403,358. U.S. patent application Ser. No. 10/423,543 is also a continuation-in-part of U.S. patent application Ser. No. 10/105,989, filed Mar. 25, 2002 (abandoned), which is a continuation of U.S. patent application Ser. No. 09/392,189, filed Sep. 9, 1999 (abandoned). U.S. patent application Ser. No. 10/423,543 is also a continuation-in-part of U.S. patent application Ser. No. 10/336,153, filed Jan. 3, 2003 (abandoned), which is a continuation of U.S. patent application Ser. No. 09/845,044, filed Apr. 27, 2001 (abandoned), which claims the benefit of U.S. Provisional Application Ser. No. 60/200,688, filed Apr. 28, 2000 (abandoned). U.S. patent application Ser. No. 10/423,543 is also a continuation-in-part of U.S. patent application Ser. No. 09/928,531, filed Aug. 13, 2001 (abandoned), which claims the benefit of U.S. Provisional Application Ser. No. 60/235,035, filed Sep. 25, 2000 (abandoned). U.S. patent application Ser. No. 10/423,543 is also a continuation-in-part of U.S. patent application Ser. No. 09/920,346, filed Jul. 31, 2001 (abandoned), which claims the benefit of U.S. Provisional Application Ser. No. 60/221,925, filed Jul. 31, 2000 (abandoned). U.S. patent application Ser. No. 10/423,543 is also a continuation-in-part of U.S. patent application Ser. No. 10/008,016, filed Nov. 8, 2001 (abandoned), which claims the benefit of U.S. Provisional Application Ser. No. 60/260,166, filed Jan. 5, 2001 (abandoned) and of U.S. Provisional Application Ser. No. 60/246,669, filed Nov. 8, 2000 (abandoned). U.S. patent application Ser. No. 10/423,543 is also a continuation-in-part of U.S. patent application Ser. No. 09/909,743, filed Jul. 20, 2001 (abandoned), which is a divisional of U.S. patent application Ser. No. 09/448,076, filed Nov. 23, 1999, now U.S. Pat. No. 6,300,092, which is a continuation-in-part of U.S. patent application Ser. No. 09/276,400, filed Mar. 25, 1999, now U.S. Pat. No. 6,140,056, which claims the benefit of U.S. Provisional Application Ser. No. 60/117,580, filed Jan. 27, 1999 (abandoned). U.S. patent application Ser. No. 10/423,543 is also a continuation-in-part of U.S. patent application Ser. No. 10/336,489, filed Jan. 2, 2003 (abandoned), which is a continuation of U.S. patent application Ser. No. 09/608,921, filed Jun. 30, 2000 (abandoned), which is a continuation-in-part of U.S. patent application Ser. No. 09/163,821, filed Sep. 30, 1998 (abandoned). U.S. patent application Ser. No. 10/423,543 is also a continuation-in-part of U.S. patent application Ser. No. 10/060,763, filed Jan. 30, 2002 (abandoned), which is a continuation of U.S. patent application Ser. No. 09/365,162, filed Jul. 30, 1999 (abandoned). The entire contents of each of the above-referenced patent applications are incorporated herein by this reference.

BACKGROUND OF THE INVENTION

The enormous variety of biochemical reactions that comprise life are nearly all mediated by a series of biological catalysts known as enzymes. Enzymes are proteins which possess specific catalytic activities that enable them to catalyze a series of reactions, hence enabling metabolic pathways to degrade and to reconstruct products needed to maintain organisms. By the binding of substrates through geometrically and physically complementary reactions, enzymes are stereospecific in binding substrates as well as in catalyzing reactions. The stringency for this stereospecificity varies as some enzymes are more specific to the identity of their substrates, while others are capable of binding multiple substrates and can catalyze numerous types of reactions.

Examples of enzymes include, for example, guanylate kinases, phophatidylinositol 4-phosphate 5-kinases, kinases, transferases, aminopeptidases, adenylate cyclases, calpain proteases, oxidoreductases, neprilysin proteases, AMP binding enzymes and lysyl oxidases. Such enzymes have the ability to, for example: (1) modulate ATP-dependent phosphorylation of GMP, dGMP, or cGMP; (2) catalyze the formation of phosphoinositol-4,5-bisphosphate via the phosphorylation of phosphatidylinositol-4-phosphate; (3) mediate the phosphoinositide signaling cascade; (4) convert a substrate or target molecule to a product (e.g., transfer of a phosphate group to a substrate or target molecule, or conversion of ATP to ADP); (5) interact with and/or phosphate transfer to a second protein; (6) modulate intra- or intercellular signaling and/or gene transcription (e.g., either directly or indirectly); (7) modulate the phosphorylation state of target molecules (e.g., a kinase or a phosphatase molecule) or the phosphorylation state of one or more proteins involved in cellular growth, metabolism, or differentiation, e.g., cardiac, epithelial, or neuronal cell growth or differentiation; (8) convert a substrate or target molecule to a product (e.g., transfer of a methyl group to or from the substrate or target molecule); (9) interact with and/or methyl transfer to a second target molecule e.g., a nucleic acid molecule (e.g., DNA or RNA), a small organic molecule (e.g., a hormone, neurotransmitter or a coenzyme) or a protein; (10) cleave a protein precursor to maturation; (11) catalyze protein degradation; (12) catalyze the formation of a covalent bond within or between an amino acid residue (e.g., a serine or threonine residue) and a phosphate moiety; (13) modulate the cAMP signal transduction pathway; (14) modulate a target cell's cAMP concentration; (15) modulate cAMP-dependent protein kinase activity, such as protein kinase A; (16) modulate a calpain protease response; (17) modulate metabolism and catabolism of biochemical molecules, e.g., molecules necessary for energy production or storage; (18) modulate betaine synthesis from choline; (19) modulate methionine synthesis from homocysteine; (20) modulate the activity of a bioactive peptide, (21) cleave a neprilysin substrate, e.g., enkephalin; (22) modulate membrane excitability, (23) influence the resting potential of membranes; (24) modulate acetyl-CoA ligase activity; (25) promote activation of acetate; (26) promote acetate utilization; (27) enhance uptake of acetate into fatty acids and biochemical products made from fatty acids (e.g., lipids and hormones such as sterol hormones); (28) crosslink an extracellular matrix component; (29) regulate bone resorption and/or metabolism; and (30) regulate copper metabolism. Accordingly, there exists a need to identify additional human enzymes, for example, for use as disease markers and as targets for identifying various therapeutic modulators.

SUMMARY OF THE INVENTION

The present invention is based, at least in part, on the discovery of novel nucleic acid molecules and proteins encoded by such nucleic acid molecules, referred to herein as "21910, 56634, 55053, 2504, 15977, 14760, 25501, 17903, 3700, 21529, 26176, 26343, 56638, 18610, 33217, 21967, h1983, m1983, 38555 or 593". The 21910, 56634, 55053, 2504, 15977, 14760, 25501, 17903, 3700, 21529, 26176, 26343, 56638, 18610, 33217, 21967, h1983, m1983, 38555 or 593 nucleic acid and protein molecules of the present invention are useful as modulating agents in regulating a variety of cellular processes, e.g., including cell proliferation, differentiation, growth and division. In particular, these nucleic acid molecules will be advantageous in the regulation of any cellular function, uncontrolled proliferation and differentiation, such as in cases of cancer. Accordingly, in one aspect, this invention provides isolated nucleic acid molecules encoding 21910, 56634, 55053, 2504, 15977, 14760, 25501, 17903, 3700, 21529, 26176, 26343, 56638, 18610, 33217, 21967, h1983, m1983, 38555 or 593 proteins or biologically active portions thereof, as well as nucleic acid fragments suitable as primers or hybridization probes for the detection of 21910, 56634, 55053, 2504, 15977, 14760, 25501, 17903, 3700, 21529, 26176, 26343, 56638, 18610, 33217, 21967, h1983, m1983, 38555 or 593-encoding nucleic acids.

The nucleotide sequence of the cDNA encoding 21910, 56634, 55053, 2504, 15977, 14760, 25501, 17903, 3700, 21529, 26176, 26343, 56638, 18610, 33217, 21967, h1983, m1983, 38555 or 593 and the amino acid sequence of 21910, 56634, 55053, 2504, 15977, 14760, 25501, 17903, 3700, 21529, 26176, 26343, 56638, 18610, 33217, 21967, h1983, m1983, 38555 or 593 polypeptides are depicted in Table 1.

TABLE 1

Sequences of the invention

| Gene Name | cDNA (SEQ ID NO:) | Protein (SEQ ID NO:) | Coding Region (SEQ ID NO:) |
|---|---|---|---|
| 21910 | SEQ ID NO: 1 | SEQ ID NO: 2 | SEQ ID NO: 3 |
| 56634 | SEQ ID NO: 5 | SEQ ID NO: 6 | SEQ ID NO: 7 |
| 55053 | SEQ ID NO: 10 | SEQ ID NO: 11 | SEQ ID NO: 12 |
| 2504 | SEQ ID NO: 18 | SEQ ID NO: 19 | SEQ ID NO: 20 |
| 15977 | SEQ ID NO: 21 | SEQ ID NO: 22 | SEQ ID NO: 23 |
| 14760 | SEQ ID NO: 24 | SEQ ID NO: 25 | SEQ ID NO: 26 |
| 25501 | SEQ ID NO: 31 | SEQ ID NO: 32 | SEQ ID NO: 33 |
| 17903 | SEQ ID NO 39 | SEQ ID NO: 40 | SEQ ID NO: 41 |
| 3700 | SEQ ID NO: 43 | SEQ ID NO: 44 | SEQ ID NO: 45 |
| 21529 | SEQ ID NO: 46 | SEQ ID NO: 47 | SEQ ID NO: 48 |
| 26176 | SEQ ID NO: 49 | SEQ ID NO: 50 | SEQ ID NO: 51 |
| 26343 | SEQ ID NO: 54 | SEQ ID NO: 55 | SEQ ID NO: 56 |
| 56638 | SEQ ID NO: 57 | SEQ ID NO: 58 | SEQ ID NO: 59 |
| 18610 | SEQ ID NO: 63 | SEQ ID NO: 64 | SEQ ID NO: 65 |
| 33217 | SEQ ID NO: 66 | SEQ ID NO: 67 | SEQ ID NO: 68 |
| 21967 | SEQ ID NO: 71 | SEQ ID NO: 72 | SEQ ID NO: 73 |
| h1983 | SEQ ID NO: 88 | SEQ ID NO: 89 | SEQ ID NO: 90 |
| m1983 | SEQ ID NO: 104 | SEQ ID NO: 105 | SEQ ID NO: 106 |
| 38555 | SEQ ID NO: 107 | SEQ ID NO: 108 | SEQ ID NO: 109 |
| 593 | SEQ ID NO: 111 | SEQ ID NO: 112 | SEQ ID NO: 113 |

Accordingly, in one aspect, the invention features a nucleic acid molecule which encodes a 21910, 56634, 55053, 2504, 15977, 14760, 25501, 17903, 3700, 21529, 26176, 26343, 56638, 18610, 33217, 21967, h1983, m1983, 38555 or 593 protein or polypeptide, e.g., a biologically active portion of the 21910, 56634, 55053, 2504, 15977, 14760, 25501, 17903, 3700, 21529, 26176, 26343, 56638, 18610, 33217, 21967, h1983, m1983, 38555 or 593 protein. In a preferred embodiment, the isolated nucleic acid molecule encodes a polypeptide having the amino acid sequence of SEQ ID NO:2, 6, 11, 19, 22, 25, 32, 40, 44, 47, 50, 55, 58, 64, 67, 72, 89, 105, 108 or 112. In other embodiments, the invention provides isolated 21910, 56634, 55053, 2504, 15977, 14760, 25501, 17903, 3700, 21529, 26176, 26343, 56638, 18610, 33217, 21967, h1983, m1983, 38555 or 593 nucleic acid molecules having the nucleotide sequence shown in SEQ ID NO:1, 3, 5, 7, 10, 12, 18, 20, 21, 23, 24, 26, 31, 33, 39, 41, 43, 45, 46, 48, 49, 51, 54, 56, 57, 59, 63, 65, 66, 68, 71, 73, 88, 90, 104, 106, 107, 109, 111 or 113. In still other embodiments, the invention provides nucleic acid molecules that are substantially identical (e.g., naturally occurring allelic variants) to the nucleotide sequence shown in SEQ ID NO:1, 3, 5, 7, 10, 12, 18, 20, 21, 23, 24, 26, 31, 33, 39, 41, 43, 45, 46, 48, 49, 51, 54, 56, 57, 59, 63, 65, 66, 68, 71, 73, 88, 90, 104, 106, 107, 109, 111 or 113. In other embodiments, the invention provides a nucleic acid molecule which hybridizes under a stringent hybridization condition as described herein to a nucleic acid molecule comprising the nucleotide sequence of SEQ ID NO:1, 3, 5, 7, 10, 12, 18, 20, 21, 23, 24, 26, 31, 33, 39, 41, 43, 45, 46, 48, 49, 51, 54, 56, 57, 59, 63, 65, 66, 68, 71, 73, 88, 90, 104, 106, 107, 109, 111 or 113, wherein the nucleic acid encodes a full length 21910, 56634, 55053, 2504, 15977, 14760, 25501, 17903, 3700, 21529, 26176, 26343, 56638, 18610, 33217, 21967, h1983, m1983, 38555 or 593 protein or an active fragment thereof.

In a related aspect, the invention further provides nucleic acid constructs which include a 21910, 56634, 55053, 2504, 15977, 14760, 25501, 17903, 3700, 21529, 26176, 26343, 56638, 18610, 33217, 21967, h1983, m1983, 38555 or 593 nucleic acid molecule described herein. In certain embodiments, the nucleic acid molecules of the invention are operatively linked to native or heterologous regulatory sequences. Also included are vectors and host cells containing the 21910, 56634, 55053, 2504, 15977, 14760, 25501, 17903, 3700, 21529, 26176, 26343, 56638, 18610, 33217, 21967, h1983, m1983, 38555 or 593 nucleic acid molecules of the invention e.g., vectors and host cells suitable for producing polypeptides.

In another related aspect, the invention provides nucleic acid fragments suitable as primers or hybridization probes for the detection of 21910, 56634, 55053, 2504, 15977, 14760, 25501, 17903, 3700, 21529, 26176, 26343, 56638, 18610, 33217, 21967, h1983, m1983, 38555 or 593-encoding nucleic acids.

In still another related aspect, isolated nucleic acid molecules that are antisense to a 21910, 56634, 55053, 2504, 15977, 14760, 25501, 17903, 3700, 21529, 26176, 26343, 56638, 18610, 33217, 21967, h1983, m1983, 38555 or 593 encoding nucleic acid molecule are provided.

In another aspect, the invention features 21910, 56634, 55053, 2504, 15977, 14760, 25501, 17903, 3700, 21529, 26176, 26343, 56638, 18610, 33217, 21967, h1983, m1983, 38555 or 593 polypeptides, and biologically active or antigenic fragments thereof that are useful, e.g., as reagents or targets in assays applicable to treatment and diagnosis of 21910, 56634, 55053, 2504, 15977, 14760, 25501, 17903, 3700, 21529, 26176, 26343, 56638, 18610, 33217, 21967, h1983, m1983, 38555 or 593-associated disorders. In another embodiment, the invention provides 21910, 56634, 55053, 2504, 15977, 14760, 25501, 17903, 3700, 21529, 26176, 26343, 56638, 18610, 33217, 21967, h1983, m1983, 38555 or 593 polypeptides having a 21910, 56634, 55053, 2504, 15977, 14760, 25501, 17903, 3700, 21529, 26176, 26343, 56638, 18610, 33217, 21967, h1983, m1983, 38555 or 593 activity.

In other embodiments, the invention provides 21910, 56634, 55053, 2504, 15977, 14760, 25501, 17903, 3700, 21529, 26176, 26343, 56638, 18610, 33217, 21967, h1983, m1983, 38555 or 593 polypeptides, e.g., a 21910, 56634, 55053, 2504, 15977, 14760, 25501, 17903, 3700, 21529, 26176, 26343, 56638, 18610, 33217, 21967, h1983, m1983, 38555 or 593 polypeptide having the amino acid sequence shown in SEQ ID NO:2, 6, 11, 19, 22, 25, 32, 40, 44, 47, 50, 55, 58, 64, 67, 72, 89, 105, 108 or 112; an amino acid sequence that is substantially identical to the amino acid sequence shown in SEQ ID NO:2, 6, 11, 19, 22, 25, 32, 40, 44, 47, 50, 55, 58, 64, 67, 72, 89, 105, 108 or 112; or an amino acid sequence encoded by a nucleic acid molecule having a nucleotide sequence which hybridizes under a stringent hybridization condition as described herein to a nucleic acid molecule comprising the nucleotide sequence of SEQ ID NO:1, 3, 5, 7, 10, 12, 18, 20, 21, 23, 24, 26, 31, 33, 39, 41, 43, 45, 46, 48, 49, 51, 54, 56, 57, 59, 63, 65, 66, 68, 71, 73, 88, 90, 104, 106, 107, 109, 111 or 113, wherein the nucleic acid encodes a full length 21910, 56634, 55053, 2504, 15977, 14760, 25501, 17903, 3700, 21529, 26176, 26343, 56638, 18610, 33217, 21967, h1983, m1983, 38555 or 593 protein or an active fragment thereof.

In a related aspect, the invention further provides nucleic acid constructs which include a 21910, 56634, 55053, 2504, 15977, 14760, 25501, 17903, 3700, 21529, 26176, 26343, 56638, 18610, 33217, 21967, h1983, m1983, 38555 or 593 nucleic acid molecule described herein.

In a related aspect, the invention provides 21910, 56634, 55053, 2504, 15977, 14760, 25501, 17903, 3700, 21529, 26176, 26343, 56638, 18610, 33217, 21967, h1983, m1983, 38555 or 593 polypeptides or fragments operatively linked to non-21910, 56634, 55053, 2504, 15977, 14760, 25501, 17903, 3700, 21529, 26176, 26343, 56638, 18610, 33217, 21967, h1983, m1983, 38555 or 593 polypeptides to form fusion proteins.

In another aspect, the invention features antibodies and antigen-binding fragments thereof, that react with, or more preferably specifically or selectively bind 21910, 56634, 55053, 2504, 15977, 14760, 25501, 17903, 3700, 21529, 26176, 26343, 56638, 18610, 33217, 21967, h1983, m1983, 38555 or 593 polypeptides.

In another aspect, the invention provides methods of screening for compounds that modulate the expression or activity of the 21910, 56634, 55053, 2504, 15977, 14760, 25501, 17903, 3700, 21529, 26176, 26343, 56638, 18610, 33217, 21967, h1983, m1983, 38555 or 593 polypeptides or nucleic acids.

In still another aspect, the invention provides a process for modulating 21910, 56634, 55053, 2504, 15977, 14760, 25501, 17903, 3700, 21529, 26176, 26343, 56638, 18610, 33217, 21967, h1983, m1983, 38555 or 593 polypeptide or nucleic acid expression or activity, e.g., using the compounds identified in the screens described herein. In certain embodiments, the methods involve treatment of conditions related to aberrant activity or expression of the 21910, 56634, 55053, 2504, 15977, 14760, 25501, 17903, 3700, 21529, 26176, 26343, 56638, 18610, 33217, 21967, h1983, m1983, 38555 or 593 polypeptides or nucleic acids, such as conditions or disorders involving aberrant or deficient 21910, 56634, 55053, 2504, 15977, 14760, 25501, 17903, 3700, 21529, 26176, 26343, 56638, 18610, 33217, 21967, h1983, m1983, 38555 or 593 expression. Examples of such disorders include, but are not limited to cellular proliferative and/or differentiative disorders, brain disorders, platelet disorders, breast disorders, colon disorders, kidney (renal) disorders, lung disorders, ovarian disorders, prostate disorders, cervical disorders, spleen disorders, thymus disorders, thyroid disorders, testis disorders, hematopoietic disorders, pancreatic disorders, skeletal muscle disorders, skin (dermal) disorders, disorders associated with bone metabolism, immune, e.g., inflammatory, disorders, cardiovascular disorders, endothelial cell disorders, liver disorders, viral diseases, pain disorders, metabolic disorders, neurological or CNS disorders, erythroid disorders, blood vessel disorders or angiogenic disorders.

The invention also provides assays for determining the activity of or the presence or absence of 21910, 56634, 55053, 2504, 15977, 14760, 25501, 17903, 3700, 21529, 26176, 26343, 56638, 18610, 33217, 21967, h1983, m1983, 38555 or 593 polypeptides or nucleic acid molecules in a biological sample, including for disease diagnosis.

In a further aspect, the invention provides assays for determining the presence or absence of a genetic alteration in a 21910, 56634, 55053, 2504, 15977, 14760, 25501, 17903, 3700, 21529, 26176, 26343, 56638, 18610, 33217, 21967, h1983, m1983, 38555 or 593 polypeptide or nucleic acid molecule, including for disease diagnosis.

In another aspect, the invention features a two dimensional array having a plurality of addresses, each address of the plurality being positionally distinguishable from each other address of the plurality, and each address of the plurality having a unique capture probe, e.g., a nucleic acid or peptide sequence. At least one address of the plurality has a capture probe that recognizes a 21910, 56634, 55053, 2504, 15977, 14760, 25501, 17903, 3700, 21529, 26176, 26343, 56638, 18610, 33217, 21967, h1983, m1983, 38555 or 593 molecule. In one embodiment, the capture probe is a nucleic acid, e.g., a probe complementary to a 21910, 56634, 55053, 2504, 15977, 14760, 25501, 17903, 3700, 21529, 26176, 26343, 56638, 18610, 33217, 21967, h1983, m1983, 38555 or 593 nucleic acid sequence. In another embodiment, the capture probe is a polypeptide, e.g., an antibody specific for 21910, 56634, 55053, 2504, 15977, 14760, 25501, 17903, 3700, 21529, 26176, 26343, 56638, 18610, 33217, 21967, h1983, m1983, 38555 or 593 polypeptides. Also featured is a method of analyzing a sample by contacting the sample to the aforementioned array and detecting binding of the sample to the array.

Other features and advantages of the invention will be apparent from the following detailed description, and from the claims.

DETAILED DESCRIPTION OF THE INVENTION

Human 21910

The present invention is based, at least in part, on the discovery of novel molecules, referred to herein as "membrane-associated guanylate kinase", "MAGK" or "21910" nucleic acid and protein molecules. Guanylate kinase molecules are novel members of a family of enzymes possessing kinase activity. Guanylate kinases are essential enzymes in nucleotide metabolism pathways catalyzing the ATP-dependent phosphorylation of either GMP to GDP or dGMP to dGDP. Guanyate kinase molecules also function in the recovery of cGMP (cGMP→GMP→GDP→GTP→cGMP) thereby serving to regulate the supply of guanine nucleotides to signal transduction pathway components (Brady et al. (1996) *J. Biol. Chem.* 271(28):16734-40; Kumar, et al. (2000) *Eur. J. Biochem.* 267(2):606). Guanylate kinases are essential to a wide range of cellular processes including but not limited to nucleotide metabolic processes (e.g., supplying the building blocks for nucleic acids), phototransduction processes (e.g., regulating the opening and/or closing of cGMP gated-channels), cellular growth and proliferation, and signaling pathways (Fitzgibbon, et al (1996) *FEBS Letters* 385:185-188).

Membrane-bound forms of guanylate kinase molecules have also been discovered. Members of the membrane-associated guanylate kinase family interact with the cytoskeleton of the cell and regulate cell proliferation, signaling pathways, and intercellular junctions. (Kim, et al. (1996) *Genomics* 31(2):223). These molecules participate in the assembly of multiprotein complexes on the inner surface of the plasma membrane and cluster ion channels, receptors, adhesion molecules and cytosolic signaling proteins at synapses, cellular junctions, and polarized membrane domains (Fannin and Anderson (1999) *Curr. Opin. Cell Biol.* 11(4):432; Dobrosotskaya, et al. (1997) *J. Biol. Chem.* 272(50):31589). In addition, membrane-associated guanylate kinases have recently been found to have a transcriptional regulatory function (Hsueh, et al. (2000) *Nature* 404(6775):298). Typically, these molecules contain multiple protein-protein interaction motifs including a PDZ domain in the N-terminal portion of the protein, followed by a SH3 domain, followed by a guanylate kinase domain at the C-terminus (Dobrosotskaya, et al., supra). Membrane-associated guanylate kinases have been found to be localized to tight junctions in epithelial cell membranes and more notably in neuronal cells (Wu, et al. (2000) *Proc. Natl. Acad. Sci. USA* 97(8):4233); Hsuesh, supra).

In humans, guanylate kinases are used as targets for cancer chemotherapy and have been found to be inhibited by the antitumor drug, 6-thioguanine. In addition, guanylate kinase activity is required for the activation of antiviral drugs such as acyclovir and ganciclovir in virus-infected cells (Brady et al., supra).

Members of the guanylate kinase family have been identified in many organisms, including *E. coli*, yeast, mouse, and human. Greater conservation has been found between mammalian guanylate kinases than between mammalian and yeast or *E. coli*. However, the overall structure of the molecule is conserved, including conservation of a "giant anion hole" active site which functions to bind nucleoside triphosphates (Brady et al., supra; Stehle and Schulz (1992) *J. Mol. Biol.* 224(4):1127).

The MAGK molecules of the present invention, through association with cell surface signaling complexes involved in cellular growth and proliferation, may play a role in the modulation of cellular growth signaling mechanisms. As used herein, the terms "cellular growth signaling mechanisms," "cell signaling," or "cell growth signaling" includes signal transmission from a cell surface signaling complex which regulates, for example, 1) cell transversal through the cell cycle, 2) cell differentiation, 3) cell survival, and/or 4) cell migration.

In a preferred embodiment, the MAGK molecules of the present invention are involved in metabolic processes of the cell and in the modulation of cellular growth signaling mechanisms. Thus, the MAGK molecules may modulate cellular growth, differentiation, or migration, and may play a role in disorders characterized by aberrantly regulated growth, proliferation, differentiation, or migration. Accordingly, in one aspect, the present invention provides methods and compositions for the diagnosis and treatment of a cellular growth or proliferation disease or disorder, e.g., cancer, including, but not limited to, lung cancer and colon cancer.

The term "treatment" as used herein, is defined as the application or administration of a therapeutic agent to a patient, or application or administration of a therapeutic agent to an isolated tissue or cell line from a patient, who has a disease, a symptom of disease or a predisposition toward a disease, with the purpose to cure, heal, alleviate, relieve, alter, remedy, ameliorate, improve or affect the disease, the symptoms of disease or the predisposition toward disease. A therapeutic agent includes, but is not limited to, small molecules, peptides, antibodies, ribozymes and antisense oligonucleotides.

A "cellular growth or proliferation disease or disorder" includes those diseases or disorders that affect cell growth or proliferation processes. As used herein, a "cellular growth or proliferation process" is a process by which a cell increases in number, size or content, by which a cell develops a specialized set of characteristics which differ from that of other cells, or by which a cell moves closer to or further from a particular location or stimulus. Such disorders include, but are not limited to, cancer, e.g., carcinoma, sarcoma, or leukemia, examples of which include, but are not limited to, colon, lung, liver, ovary, and breast; tumorigenesis and metastasis; skeletal dysplasia; hepatic disorders; and hematopoietic and/or myeloproliferative disorders.

The novel MAGK molecules of the present invention have increased expression in tumor cells, e.g., lung tumor cells and colon tumor cells, as compared to normal lung and colon cells. Increased expression of MAGK in tumor cells results in an increase in cell growth signaling, thereby increasing the cellular growth and proliferation of tumor cells. Accordingly, the MAGK molecules of the present invention provide novel diagnostic targets and therapeutic agents to control MAGK-related disorders, e.g., cellular growth or proliferation diseases or disorders, e.g., cancer, including, but not limited to colon cancer or lung cancer. Accordingly, the present invention further provides methods for identifying the presence of a MAGK nucleic acid or polypeptide molecule associated with a cellular growth or proliferation disease or disorder. In addition, the invention provides methods for identifying a subject at risk for a cellular growth or proliferation disease or disorder, by detecting the presence of a MAGK nucleic acid or polypeptide molecule, or by detecting aberrant or abnormal MAGK expression or activity.

The invention also provides a method for identifying a compound capable of treating a cellular growth or proliferation disease or disorder, characterized by aberrant MAGK nucleic acid expression or MAGK protein activity by assaying the ability of the compound to modulate the expression of a MAGK nucleic acid or the activity of a MAGK protein. Furthermore, the invention provides a method for treating a subject having a cellular growth or proliferation disease or disorder characterized by aberrant MAGK protein activity or aberrant MAGK nucleic acid expression by administering to the subject a MAGK modulator which is capable of modulating MAGK protein activity or MAGK nucleic acid expression.

Moreover, the invention provides a method for identifying a compound capable of modulating cellular growth and/or proliferation and cellular signaling by modulating the expression of a MAGK nucleic acid or the activity of a MAGK protein. The invention provides a method for modulating cellular growth and/or proliferation and cellular signaling comprising contacting an endothelial cell with a MAGK modulator.

The present invention is directed to novel members of the guanylate kinase family of enzymes, e.g. the MAGK proteins, biologically active fragments thereof, homologues thereof, and/or nucleic acid molecules encoding such proteins, homologues and/or biologically active fragments, and the use thereof for treating and/or diagnosing a cellular growth or proliferation disease or disorder. The term "family" when referring to the protein and nucleic acid molecules of the invention is intended to mean two or more proteins or nucleic acid molecules having a common structural domain or motif and having sufficient amino acid or nucleotide sequence homology as defined herein. Such family members can be naturally or non-naturally occurring and can be from either the same or different species. For example, a family can contain a first protein of human origin, as well as other, distinct proteins of human origin or alternatively, can contain homologues of non-human origin, e.g., mouse or monkey proteins. Members of a family may also have common functional characteristics.

Accordingly, in one embodiment, a MAGK molecule of the present invention is identified based on the presence of a "ATP/GTP-binding site motif A (P-loop)" in the protein or corresponding nucleic acid molecule. As used herein, the term "ATP/GTP-binding site motif A (P-loop)" includes a protein motif having an amino acid sequence of about 8 amino acid residues. Preferably, a P-loop has about 5-8 residues and the following consensus sequence: [AG]—X(4)-G-K—[ST] (SEQ ID NO:4) (Saraste M., Sibbald P. R., Wittinghofer A. (1990) *Trends Biochem. Sci.* 15:430-434). To identify the presence of a ATP/GTP-binding site motif A (P-loop) in a MAGK protein, and make the determination that a protein of interest has a particular motif, the amino acid sequence of the protein may be searched against a database of known protein motifs (e.g., the ProSite database). The ATP/GTP-binding site motif A (P-loop) has been assigned ProSite accession number PS00017. A search was performed against the ProSite database resulting in the identification of a ATP/GTP-binding site motif A (P-loop) in the amino acid sequence of human MAGK (SEQ ID NO:2) at about residues 404-411 of SEQ ID NO:2.

In another embodiment, a MAGK molecule of the present invention is identified based on the presence of a "guanylate kinase domain" in the protein or corresponding nucleic acid molecule. As used herein, the term "guanylate kinase domain" includes a protein domain having an amino acid sequence of about 50-200 amino acid residues and a bit score of about 50, 60, 70, 80, 90, 100, 110, 120, 130, 140, 150, 160, 170, 180, 190, 200, 210, or 220 or more. Preferably, a guanylate kinase domain includes at least about 100-200, or more preferably about 109 amino acid residues, and a bit score of at least 139.4. To identify the presence of a guanylate kinase domain in a MAGK protein, and make the determination that a protein of interest has a particular profile, the amino acid sequence of the protein may be searched against a database of known protein domains (e.g., the HMM database). A search was performed against the HMM database resulting in the identification of a guanylate kinase domain in the amino acid sequence of human MAGK (SEQ ID NO:2) at about residues 515-624 of SEQ ID NO:2.

A guanylate kinase domain can further be characterized based on the presence of a guanylate kinase consensus sequence in the protein or corresponding nucleic acid molecule. As used herein, the term "guanylate kinase domain" includes a protein motif having an amino acid sequence of about 18 amino acid residues. Preferably, a guanylate kinase domain has about 15-20 residues. To identify the presence of a guanylate kinase domain in a MAGK protein, and make the determination that a protein of interest has a particular motif, the amino acid sequence of the protein may be searched against a database of known protein motifs (e.g., the ProSite database). The guanylate kinase domain has been assigned ProSite accession number PS00856. A search was performed against the ProSite database resulting in the identification of a guanylate kinase domain in the amino acid sequence of human MAGK (SEQ ID NO:2) at about residues 514-531 of SEQ ID NO:2.

In another embodiment, a MAGK molecule of the present invention is identified based on the presence of a "PDZ domain" in the protein or corresponding nucleic acid molecule. As used herein, the term "PDZ domain" includes a protein domain having an amino acid sequence of about 50-200 amino acid residues and a bit score of about 20, 30, 40, 50, 60, 70, 80, 90, 100, 110, 120, 130, 140, 150, 160, 170, 180, 190 or 200 or more. Preferably, a PDZ domain includes at least about 50-150, or more preferably about 79 amino acid residues, and a bit score of at least 52.4. To identify the presence of a PDZ domain in a MAGK protein, and make the determination that a protein of interest has a particular profile, the amino acid sequence of the protein may be searched against a database of known protein domains (e.g., the HMM database). A search was performed against the HMM database resulting in the identification of a PDZ domain in the amino acid sequence of human MAGK (SEQ ID NO:2) at about residues 256-335 of SEQ ID NO:2.

In another embodiment, a MAGK molecule of the present invention is identified based on the presence of a "SH3 domain" in the protein or corresponding nucleic acid molecule. As used herein, the term "SH3 domain" includes a protein domain having an amino acid sequence of about 50-150 amino acid residues and a bit score of about 5, 10, 20, 30, 40, 50, 60, 70, 80, 90, 100, 110, 120, 130, 140, 150 or more. Preferably, a SH3 domain includes at least about 50-100, or more preferably about 67 amino acid residues, and a bit score of at least 5.2. To identify the presence of a SH3 domain in a MAGK protein, and make the determination that a protein of interest has a particular profile, the amino acid sequence of the protein may be searched against a database of known protein domains (e.g., the HMM database). A search was performed against the HMM database resulting in the identification of a SH3 domain in the amino acid sequence of human MAGK (SEQ ID NO:2) at about residues 348-415 of SEQ ID NO:2.

In a preferred embodiment, the MAGK molecules of the invention include at least one, preferably two, more preferably three or more or more of the following domains: an ATP/GTP-binding site motif A (P-loop), a guanylate kinase domain, a PDZ domain, and a SH3 domain.

In yet another embodiment, isolated proteins of the present invention, preferably MAGK proteins, have an amino acid sequence sufficiently identical to the amino acid sequence of SEQ ID NO:2, or are encoded by a nucleotide sequence sufficiently identical to SEQ ID NO:1 or 3. As used herein, the term "sufficiently identical" refers to a first amino acid or nucleotide sequence which contains a sufficient or minimum number of identical or equivalent (e.g., an amino acid residue which has a similar side chain) amino acid residues or nucleotides to a second amino acid or nucleotide sequence such that the first and second amino acid or nucleotide sequences share common structural domains or motifs and/or a common functional activity. For example, amino acid or nucleotide sequences which share common structural domains have at least 30%, 40%, or 50% homology, preferably 60% homology, more preferably 70%-80%, and even more preferably 90-95% homology across the amino acid sequences of the domains and contain at least one and preferably two structural domains or motifs, are defined herein as sufficiently identical. Furthermore, amino acid or nucleotide sequences which share at least 30%, 40%, or 50%, preferably 60%, more preferably 70-80%, or 90-95% homology and share a common functional activity are defined herein as sufficiently identical.

As used interchangeably herein, an "MAGK activity", "biological activity of MAGK," or "functional activity of MAGK," refers to an activity exerted by a MAGK protein, polypeptide or nucleic acid molecule on a MAGK responsive cell or tissue, or on a MAGK protein substrate, as determined in vivo, or in vitro, according to standard techniques. As used herein, a "membrane-associated guanylate kinase activity" includes ATP-dependent phosphorylation of GMP (or dGMP) into GDP (or dGDP) involved, for example, in the production of molecules necessary for signal transduction, cell signaling, cellular growth, cellular proliferation, and the like. In one embodiment, a MAGK activity is a direct activity, such as an association with a MAGK-target molecule. As used herein, a "target molecule" or "binding partner" is a molecule with which a MAGK protein binds or interacts in nature, such that MAGK-mediated function is achieved, e.g., modulation of cellular signaling, growth, and/or proliferation. A MAGK target molecule can be a non-MAGK molecule or a MAGK protein or polypeptide of the present invention (e.g., ATP). In an exemplary embodiment, a MAGK target molecule is a MAGK ligand (e.g., GMP, dGMP). Alternatively, a MAGK activity is an indirect activity, such as a cellular signaling activity mediated by interaction of the MAGK protein with a MAGK ligand. The biological activities of MAGK are described herein. For example, the MAGK proteins of the present invention can have one or more of the following activities: i) interaction of a MAGK protein molecule with a non-MAGK protein molecule (e.g. GMP, ATP), ii) modification of a MAGK substrate (e.g. GMP or dGMP), iii) assembly of protein complexes at cell-junctions, iv) interaction with the cellular cytoskeleton, and v) interaction between a membrane-bound MAGK protein and a non-MAGK protein. In yet another preferred embodiment, a MAGK activity is at least one or more of the following activities: 1) modulation of ATP-dependent phosphorylation of GMP, dGMP, or cGMP 2) modulation of cellular signal transduction, 3) modulation of metabolism or catabolism of metabolically important biomolecules (e.g., nucleotides), 4) modulation of cellular growth and differentiation, 5) modulation of cellular proliferation, a 6) modulation of cell signaling mechanisms, e.g., cellular growth signaling mechanisms, 7) modulation of intercellular junctions, 8) modulation of transcription, and 9) modulation of paracellular pathways.

Accordingly, another embodiment of the invention features isolated MAGK proteins and polypeptides having a MAGK activity. Other preferred proteins are MAGK proteins having one or more of the following domains: an ATP/GTP-binding site motif A (P-loop), a guanylate kinase domain, a PDZ domain, a SH3 domain, and, preferably, a MAGK activity.

Additional preferred proteins have one or more of the following domains: an ATP/GTP-binding site motif A (P-loop), a guanylate kinase domain, a PDZ domain, a SH3 domain, and are, preferably, encoded by a nucleic acid molecule having a nucleotide sequence which hybridizes under stringent hybridization conditions to a complement of a nucleic acid molecule comprising the nucleotide sequence of SEQ ID NO:1 or 3.

The nucleotide sequence of the isolated human MAGK cDNA and the predicted amino acid sequence of the human MAGK polypeptide are shown in SEQ ID NOs:1 and 2, respectively.

Isolation of the 21910 or "MAGK" cDNA

The invention is based, at least in part, on the discovery of a human gene encoding a novel protein, referred to herein as 21910 or MAGK. The entire sequence of human clone Fbh21910 was determined and found to contain an open reading frame termed human "21910" or "MAGK", set forth in SEQ ID NO:1 and 3. The 74.36 kD MAGK protein comprises about 675 amino acids and is shown in SEQ ID NO:2. The coding region (open reading frame) of SEQ ID NO:1, is set forth as SEQ ID NO:3.

Analysis of the Human 21910 or MAGK Molecule

The amino acid sequence of human MAGK was analyzed using the program PSORT to predict the localization of the protein within the cell. This program assesses the presence of different targeting and localization amino acid sequences within the query sequence. The results of the analysis predict that human MAGK (SEQ ID NO:2) is intracellular (e.g. nuclear, cytoplasmic, cytoskeletal).

A search of the amino acid sequence of MAGK was also performed against the ProSite database. This search resulted in the identification of a "ATP/GTP-binding site motif A (P-loop)" in the amino acid sequence of MAGK (SEQ ID NO:2) at about residues 404-411 and a "guanylate kinase signature" in the amino acid sequence of MAGK (SEQ ID NO:2) at about residues 514-531. This search also resulted in the identification of a potential N-glycosylation site at about residues 82-85 of SEQ ID NO:2, a number of potential protein kinase C phosphorylation sites at about residues 84-86, 130-132, 253-255, 270-272, 432-434, 514-516, 517-519, 562-564, 569-571, 576-578, 581-583, and 584-586 of SEQ ID NO:2, a number of potential casein kinase II phosphorylation sites at about residues 14-17, 25-28, 97-100, 137-140, 143-146, 383-386, 422-425, 465-468, 517-520, 558-561, and 646-649 of SEQ ID NO:2, a tyrosine kinase phosphorylation site at about residues 586-593 of SEQ ID NO:2, a number of potential N-myristoylation sites at about residues 205-210, 247-2525, and 405-410 of SEQ ID NO:2, and a potential amidation site at about residues 72-76 of SEQ ID NO:2.

A search of the amino acid sequence of MAGK was also performed against the HMM database. This search resulted in the identification of a "guanylate kinase domain" in the amino acid sequence of MAGK (SEQ ID NO:2) at about residues 515-624 (score=139.4), a "PDZ domain" in the amino acid sequence of MAGK (SEQ ID NO:2) at about residues 256-335 (score=52.4), and a "SH3 domain" in the amino acid sequence of MAGK (SEQ ID NO:2) at about residues 348-415 (score=5.2).

Other HMM hits of interest that were identified in the HMM database include, for example, a "NAD-dependent DNA ligase domain" at about residues 529-535 of SEQ ID NO:2 (score=2.3), an "X-Pro dipeptidyl-peptidase domain" at about residues 642-658 of SEQ ID NO:2 (score=−0.0), and a "caulimovirus movement protein domain" at about residues 420-673 of SEQ ID NO:2 (score=−184.0).

Tissue Distribution of 21910 or MAGK by In situ Analysis

For in situ analysis, various tissues, e.g. tissues obtained from normal lung and colon and lung and colon tumors, were first frozen on dry ice.

In situ hybridization results indicated no expression in 2 normal lung samples. By contrast, expression was detected in 2 of 4 lung tumor samples. Results further indicated no expression in 3 normal tumor samples and strong expression in 4 of 4 primary colon tumors tested and 3 of 3 colon metastases tested. Breast and ovary tissue also showed tumor specific expression.

Tissue Expression Analysis of 21910 or MAGK mRNA Using TaqMan™ Analysis

This example describes the tissue distribution of human MAGK mRNA (huMAGK) in a variety of cells and tissues, as determined using the TaqMan™ procedure.

The expression levels of human 21910 or MAGK mRNA in various human cell types and tissues was first determined in an array profiling experiment comparing the expression of genes in lung tumor cell lines versus normal bronchial epithelium. These experiments demonstrated that MAGK expression is increased 2-fold in a small cell lung tumor line as compared to normal epithelium.

The RNA used in the array profiling experiment was isolated from the following cell lines: NHBE (available from Clonetics®) and NCI-H69 (available from ATCC®). NHBE cells were grown in BEGM (bronchial epithelium growth) Bulletkit® medium. The cells were grown to 80% confluency in a T175 flask and harvested for RNA by the Qiagen® Midi RNA preparation method. NCI-H69 cells were grown in suspension in T175 flasks in RPMI+2% Hyclone FBS, 2 mM L-Glutamine, 10 mM HEPES, and ¹⁄₁₀₀ Gibco® Selenium/Insulin/Transferrin supplement medium. RNA was prepared with the Qiagen® RNA Midi Kit, as directed by the manufacturer.

The expression levels of human 21910 or MAGK mRNA in various human cell types and tissues were analyzed in detail in a second experiment using the TaqMan™ procedure. As shown in Table 2, the highest 21910 or MAGK expression was detected in brain, epithelial cells, and fetal heart.

TABLE 2

Expression of Human MAGK

| Tissue Source | Mean huMAGK CT Value | Mean Beta 2 CT Value | Normalized Expression |
|---|---|---|---|
| Aorta/normal | 35.91 | 24.30 | 0.52 |
| Fetal heart/normal | 27.07 | 20.91 | 22.72 |
| Heart/normal | 27.99 | 20.00 | 6.39 |
| Heart/CHF | 29.27 | 21.82 | 9.32 |
| Vein/normal | 30.94 | 20.60 | 1.25 |
| Spinal cord/normal | 27.43 | 20.11 | 10.17 |
| Brain cortex/normal | 26.85 | 22.17 | 63.15 |
| Brain hypothalamus | 26.48 | 21.08 | 38.47 |
| Glial cells (Astro) | 27.69 | 22.54 | 45.91 |
| Brain/Glioblastoma | 28.13 | 19.46 | 3.99 |
| Breast/normal | 29.03 | 20.52 | 4.47 |
| Breast tumor/IDC | 29.08 | 19.77 | 2.56 |
| OVARY/normal | 31.24 | 21.99 | 2.67 |
| OVARY/tumor | 29.61 | 20.44 | 2.82 |
| Pancreas | 32.24 | 25.20 | 12.34 |
| Prostate/normal | 28.34 | 20.32 | 6.26 |
| Prostate/tumor | 27.04 | 19.23 | 7.24 |
| Colon/normal | 27.83 | 19.13 | 3.91 |
| Colon/tumor | 26.83 | 19.82 | 12.60 |
| Colon/IBD | 29.96 | 19.39 | 1.05 |
| Kidney/normal | 28.14 | 21.61 | 17.58 |
| Liver/normal | 29.76 | 20.11 | 2.02 |
| Liver fibrosis | 30.51 | 21.19 | 2.54 |
| Fetal liver/normal | 30.62 | 22.42 | 5.54 |
| Lung/normal | 28.89 | 19.04 | 1.77 |
| Lung/tumor | 28.32 | 19.55 | 3.73 |
| Lung/COPD | 28.09 | 19.19 | 3.40 |
| Spleen/normal | 33.65 | 21.52 | 0.36 |
| Tonsil/normal | 30.00 | 19.09 | 0.85 |
| Lymphnode/normal | 30.47 | 19.71 | 0.94 |
| Thymus/normal | 28.29 | 20.49 | 7.26 |
| Epithelial Cells | 27.68 | 21.46 | 21.72 |
| Endothelial Cells | 30.77 | 22.01 | 3.73 |
| Skeletal Muscle | 29.17 | 21.74 | 9.42 |
| Fibroblasts(Dermal) | 30.38 | 20.04 | 1.26 |
| Skin/normal | 31.58 | 22.05 | 2.20 |
| Adipose/normal | 29.83 | 20.08 | 1.89 |
| Osteoblast(primary) | 29.21 | 21.17 | 6.19 |
| Osteoblasts(Undiff) | 28.89 | 20.09 | 3.64 |
| Osteoblasts (Diff.) | 28.59 | 19.16 | 2.36 |
| Osteoclasts | 30.91 | 18.58 | 0.32 |
| Aortic SMC Early | 28.86 | 21.39 | 9.16 |
| Aortic SMC Late | 31.23 | 24.20 | 12.47 |
| Shear HUVE C | 28.63 | 21.41 | 10.93 |
| Static HUVE C | 28.75 | 21.56 | 11.16 |
| Osteoclast(Undiff.) | 32.69 | 17.97 | 0.06 |

As shown in Table 3, increased expression of human 21910 or MAGK was detected in 6 of 8 lung tumor samples (T) versus normal lung tissue samples (N). As shown in Table 4, increased expression of huMAGK was detected in 4 of 7 colon tumor samples (T) versus normal colon tissue samples (N).

TABLE 3

Human MAGK Expression in Clinical Lung Samples

| Tissue Source | Mean huMAGK CT Value | Mean Beta 2 CT Value | Normalized Expression |
|---|---|---|---|
| Lung N | 33.1 | 22.3 | 6.2 |
| Lung N | 29.3 | 19.1 | 9.3 |
| Lung N | 24.9 | 15.2 | 13.1 |
| Lung N | 26.9 | 16.4 | 7.3 |
| Lung T | 24.9 | 16.3 | 30.3 |
| Lung T | 25.7 | 17.5 | 37.2 |
| Lung T | 28.1 | 17.9 | 9.2 |

TABLE 3-continued

Human MAGK Expression in Clinical Lung Samples

| Tissue Source | Mean huMAGK CT Value | Mean Beta 2 CT Value | Normalized Expression |
|---|---|---|---|
| Lung T | 26.6 | 17.2 | 16.3 |
| Lung T | 26.9 | 19.2 | 54.4 |
| Lung T | 27.8 | 19.3 | 29.5 |
| Lung T | 27.0 | 17.9 | 20.1 |
| Lung T | 26.4 | 18.0 | 31.7 |

TABLE 4

Human MAGK Expression in Clinical Colon Samples

| Tissue Source | Mean huMAGK CT Value | Mean Beta 2 CT Value | Normalized Expression |
|---|---|---|---|
| Colon N | 26.8 | 16.9 | 13.7 |
| Colon N | 30.4 | 21.0 | 18.6 |
| Colon N | 27.9 | 18.1 | 15.0 |
| Colon N | 25.7 | 16.8 | 27.7 |
| Colon T | 24.4 | 16.3 | 49.2 |
| Colon T | 24.3 | 17.3 | 102.6 |
| Colon T | 25.2 | 16.2 | 25.3 |
| Colon T | 26.3 | 17.1 | 21.4 |
| Colon T | 24.4 | 16.4 | 49.0 |
| Colon T | 32.0 | 23.6 | 37.7 |
| Colon T | 25.5 | 16.1 | 19.2 |
| Liver Met | 26.4 | 17.2 | 21.8 |
| Liver Met | 29.0 | 19.6 | 19.7 |
| Liver Met | 28.8 | 18.1 | 7.7 |
| Liver Met | 29.4 | 17.8 | 4.1 |
| Liver N | 28.9 | 17.4 | 4.3 |
| Liver N | 31.2 | 23.0 | 44.7 |

These data reveal a significant up-regulation of MAGK mRNA in colon and lung carcinomas. Given that the mRNA for MAGK is expressed in a variety of tumors, with significant up-regulation in carcinoma samples in comparison to normal samples, it is believed that inhibition of MAGK activity may inhibit tumor progression by inhibiting cell growth signaling and cellular growth and proliferation.

Human 56634

The present invention is based, at least in part, on the discovery of a novel phosphatidylinositol 4-phosphate 5-kinase termed 56634. The human 56634 sequence (SEQ ID NO:5), which is approximately 3224 nucleotides long including untranslated regions, contains a predicted methionine-initiated coding sequence of about 1266 nucleotides, including the termination codon. The coding sequence encodes a 421 amino acid protein (SEQ ID NO:6).

Human 56634 contains the following regions or other structural features: a phosphatidylinositol 4-phosphate 5-kinase domain (PFAM Accession Number PF01504) located at about amino acid residues 72 to 421 of SEQ ID NO:6; one predicted N-glycosylation site (PS00001) at about amino acids 165 to 168 of SEQ ID NO:6; seven predicted Protein Kinase C phosphorylation sites (PS00005) at about amino acids 28 to 30, 79 to 81, 208 to 210, 229 to 231, 239 to 241, 338 to 340, and 391 to 393 of SEQ ID NO:6; ten predicted Casein Kinase II phosphorylation sites (PS00006) located at about amino 58 to 61, 132 to 135, 155 to 158, 229 to 232, 239 to 242, 294 to 297, 307 to 310, 327 to 330, 349 to 352, and 377 to 380 of SEQ ID NO:6; one predicted tyrosine kinase phosphorylation sites (PS00007) from about amino acid 114 to 122 of SEQ ID NO:6; and four predicted N-myristoylation sites (PS00008) from about amino acid 54 to 59, 221 to 226, 323 to 328, and 397 to 402 of SEQ ID NO:6.

For general information regarding PFAM identifiers, PS prefix and PF prefix domain identification numbers, refer to Sonnhammer et al. (1997) Protein 28:405-420.

Signal transduction through phosphoinositol lipids plays an important role in various cellular processes, including vesicular secretion, cytoskeletal organization, and cell growth and differentiation. The phosphatidylinositol (PI) signal transduction pathway is regulated, in part, by the conversion of PI, a membrane lipid bearing a sugar moiety attached via an intermediate phosphate residue, into singly, doubly, and triply phosphorylated products (Carpenter and Cantley (1996) Curr Opin Cell Biol 8:153-158). A crucial step in the pathway occurs when phosphatidylinositol 4-phosphate (PIP) is phosphorylated to become phosphatidylinositol 4,5-bisphosphate (PIP2), a step catalyzed by phosphatidylinositol 4-phosphate 5-kinase (Boronenkov and Anderson (1995) J Biol Chem 270:2881-2884.). The hydrolysis of PIP2 by phospholipase C (PLC) produces the second messengers diacylglycerol (DAG) and inositol tris-phosphate (IP3). DAG is an activator of protein kinase C (PKC) and IP3 plays an important role in the release of intracellular calcium. In addition, PIP2 is converted into phosphatidylinositol 3,4,5-tris-phosphate, which activates some PKC isoforms. Thus, the phosphatidylinositol 4-phosphate 5-kinase family of proteins plays an important role in the regulation of the phosphoinositide signaling cascade by catalyzing key phosphorylation events.

The 56634 protein contains a significant number of structural characteristics in common with members of the phosphatidylinositol 4-phosphate 5-kinase (PIP5K) family. The phosphatidylinositol 4-phosphate 5-kinase family comprises a number of related enzymes that share a common catalytic mechanism. PIP5K catalyses the formation of phosphoinositol-4,5-bisphosphate via the phosphorylation of phosphatidylinositol-4-phosphate, a precursor in the phosphinositide signaling pathway. Phosphatidylinositol 4-phosphate 5-kinase has been shown to be required for vesicular secretion and trafficking of a wide variety of cells (Hay et al. (1995) Nature 374:173-7; Yamamoto et al. (1995) Mol Biol Cell 6:525-39). In addition, there is evidence that phosphatidylinositol 4-phosphate 5-kinase is involved in signal transduction and regulation of the actin cytoskeleton via the interaction with the Rho family of small G proteins (Chong et al. (1994) Cell 79:507-13; Ren et al. (1996) Mol Biol Cell 7:435-442), suggesting a role in cell movement and metastasis.

Thus, this (PIP5K) family includes enzymes critical for the proper function of many physiological systems, including vesicle secretion and trafficking, cell signaling, and cellular proliferation and differentiation.

A 56634 polypeptide can include a "phosphatidylinositol 4-phosphate 5-kinase domain" or regions homologous with a "phosphatidylinositol 4-phosphate 5-kinase domain".

As used herein, the term "phosphatidylinositol 4-phosphate 5-kinase domain" includes an amino acid sequence of about 200-500 amino acid residues in length and having a bit score for the alignment of the sequence to the phosphatidylinositol 4-phosphate 5-kinase domain profile (Pfam HMM) of at least 100. Preferably, a phosphatidylinositol 4-phosphate 5-kinase domain includes at least about 200 to 500 amino acids, more preferably about 250 to 450 amino acid residues, or about 300 to 400 amino acids and has a bit score for the alignment of the sequence to the phosphatidylinositol 4-phosphate 5-kinase domain (HMM) of at least 100, preferably at least 200, 300, 400 or greater. The phosphatidylinositol 4-phosphate 5-kinase domain (HMM) has been assigned the PFAM Accession Number PF01504. The phosphatidylinositol 4-phosphate 5-kinase domain (HMM) has been assigned the SMART identifier PIPK_2. An alignment of the phosphatidylinositol 4-phosphate 5-kinase domain (amino acids 72 to 421 of SEQ ID NO:6) of human 56634 with the PIPK_2 consensus amino acid sequences derived from a hidden Markov model derived from SMART yielded a score of 586.8 (E=1.4e-172). The PIPK_2 sequence is depicted as SEQ ID NO:9. An alignment of the phosphatidylinositol 4-phosphate 5-kinase domain (amino acids 124 to 420 of SEQ ID NO:6) of human 56634 with the PIP5K consensus amino acid sequences derived from a hidden Markov model derived from PFAM yielded a score of 530.2 (E=1.5e-155). The PIP5K sequence is depicted as SEQ ID NO:8.

In a preferred embodiment 56634 polypeptide or protein has a "phosphatidylinositol 4-phosphate 5-kinase domain" or a region which includes at least about 200 to 500, more preferably about 250 to 450, or 300 to 400 amino acid residues and has at least about 60%, 70% 80% 90% 95%, 99%, or 100% homology with a "phosphatidylinositol 4-phosphate 5-kinase," e.g., the phosphatidylinositol 4-phosphate 5-kinase domain of human 56634 (e.g., residues 72 to 421 of SEQ ID NO:6).

To identify the presence of a "phosphatidylinositol 4-phosphate 5-kinase" domain in a 56634 protein sequence, and make the determination that a polypeptide or protein of interest has a particular profile, the amino acid sequence of the protein can be searched against the Pfam database of HMMs (e.g., the Pfam database, release 2.1) using the default parameters. For example, the hmmsf program, which is available as part of the HMMER package of search programs, is a family specific default program for MILPAT0063 and a score of 15 is the default threshold score for determining a hit. Alternatively, the threshold score for determining a hit can be lowered (e.g., to 8 bits). A description of the Pfam database can be found in Sonhammer et al. (1997) Proteins 28(3):405-420 and a detailed description of HMMs can be found, for example, in Gribskov et al. (1990) Meth. Enzymol. 183:146-159; Gribskov et al. (1987) Proc. Natl. Acad. Sci. USA 84:4355-4358; Krogh et al. (1994) J. Mol. Biol. 235:1501-1531; and Stultz et al. (1993) Protein Sci. 2:305-314, the contents of which are incorporated herein by reference. A search was performed against the HMM database resulting in the identification of a "phosphatidylinositol 4-phosphate 5-kinase" domain in the amino acid sequence of human 56634 at about residues 124-420 of SEQ ID NO:6. The sequence of the identified Pfam "phosphatidylinositol 4-phosphate 5-kinase" domain is depicted in SEQ ID NO:8.

To identify the presence of a "phosphatidylinositol 4-phosphate 5-kinase" domain in a 56634 protein sequence, and make the determination that a polypeptide or protein of interest has a particular profile, the amino acid sequence of the protein can be searched against a SMART database (Simple Modular Architecture Research Tool) of HMMs as described in Schultz et al. (1998), Proc. Natl. Acad. Sci. USA 95:5857 and Schultz et al. (200) Nucl. Acids Res 28:231. The database contains domains identified by profiling with the hidden Markov models of the HMMer2 search program (R. Durbin et al. (1998) Biological sequence analysis: probabilistic models of proteins and nucleic acids. Cambridge University Press). The database also is extensively annotated and monitored by experts to enhance accuracy. A search was performed against the HMM database resulting in the identification of a "phosphatidylinositol 4-phosphate 5-kinase" domain in the amino acid sequence of human 56634 at about residues 72 to 421 of SEQ ID NO:6. The sequence of the identified SMART "phosphatidylinositol 4-phosphate 5-kinase" domain is depicted in SEQ ID NO:9.

A 56634 polypeptide can include a "phosphatidylinositol 4-phosphate 5-kinase domain" or regions homologous with a "phosphatidylinositol 4-phosphate 5-kinase domain." A 56634 polypeptide can optionally further include at least one N-glycosylation site; at least one, two, three, four, five, six, preferably seven protein kinase C phosphorylation sites; at least one, two, three, four, five, six, seven, eight, nine, preferably ten, casein kinase II phosphorylation sites; at least one tyrosine kinase phosphorylation site; at least one, two, three, preferably four, N-myristylation sites.

As the 56634 polypeptides of the invention may modulate 56634-mediated activities, they may be useful as of for developing novel diagnostic and therapeutic agents for 56634-mediated or related disorders, e.g., cancer, as described below.

As used herein, a "56634 activity", "biological activity of 56634" or "functional activity of 56634", refers to an activity exerted by a 56634 protein, polypeptide or nucleic acid molecule. For example, a 56634 activity can be an activity exerted by 56634 in a physiological milieu on, e.g., a 56634-responsive cell or on a 56634 substrate, e.g., a protein substrate. A 56634 activity can be determined in vivo or in vitro. In one embodiment, a 56634 activity is a direct activity, such as an association with a 56634 target molecule. A "target molecule" or "binding partner" is a molecule with which a 56634 protein binds or interacts in nature. In an exemplary embodiment, 56634 is an enzyme for converting phosphatidylinositol 4-phosphate (PIP) to phosphatidylinositol 4,5-bis-phosphate (PIP2).

A 56634 activity can also be an indirect activity, e.g., a cellular signaling activity mediated by interaction of the 56634 protein with a 56634 receptor. The features of the 56634 molecules of the present invention can provide similar biological activities as phosphatidylinositol 4-phosphate 5-kinase family members. For example, the 56634 proteins of the present invention can have one or more of the following activities: (1) catalyses the formation of phosphoinositol-4,5-bisphosphate via the phosphorylation of phosphatidylinositol-4-phosphate; (2) mediates the phosphoinositide signaling cascade; (3) mediates vesicular trafficking; or (4) mediates organization of the cytoskeleton. As a result, the 56634 protein may have a critical function in one or more of the following physiological processes: (a) vesicular secretion; (b) phosphoinositide signaling; or (c) cell proliferation and differentiation.

Several lines of evidence have shown coordinate increases in phosphatidylinositol and PIP kinase activities in human cancer cells, suggesting an increased capacity for signal transduction. Among PIPKs, two major subtypes (types I and II), each comprising two isoforms (Ia, Ib, IIa, IIb), have been identified to date. Type II phosphatidylinositol phosphate kinase (PIPKII) is an enzyme responsible for the synthesis of phosphatidylinositol-4,5-bisphosphate (PI-4,5-P(2)) from phosphatidylinositol-5-phosphate (PI-5-P). Mitogenic stimulation, such as by serum, EGF, and PDGF treatment, results in phosphorylation in vivo of rat PIPKIIg (JBC 273: 20292, 1998). In addition, PIPKIIb isoform has also been show to interact not only with the EGF receptor, but also selectively with other members of the ErbB tyrosine kinase family (Cell Signal 11:171, 1999).

As described below, expression of 56634 is increased after the treatment of mitogens, including EGF and serum. In addition expression of 56634 is increased in many clinical tumor tissues when compared to normal tissue controls, suggesting an increased capacity for PIP kinase mediated signal transduction. Therefore, inhibition of 56634 may reduce the signaling potential of cancer cells, thereby halting and possibly reducing the growth of tumor cells. Thus, the 56634 molecules can act as novel diagnostic targets and therapeutic agents for controlling proliferation and differentiation related disorders.

Examples of such disorders include cancer, e.g., ovarian, breast, lung or colon cancer. Thus, the 56634 molecules can act as novel diagnostic targets and therapeutic agents for controlling one or more of cellular proliferative and/or differentiative disorders.

Identification and Characterization of Human 56634 cDNA

The human 56634 sequence (SEQ ID NO:5) is approximately 3224 nucleotides long. The nucleic acid sequence includes an initiation codon (ATG) and a termination codon (TAA). The region between and inclusive of the initiation codon and the termination codon is a methionine-initiated coding sequence of about 1266 nucleotides, including the termination codon (nucleotides indicated as "coding" of SEQ ID NO:5; SEQ ID NO:7). The coding sequence encodes a 421 amino acid protein (SEQ ID NO:6).

Tissue Distribution of 56634 mRNA by TaqMan Analysis and In Situ Hybridization

Endogenous human 56634 gene expression was determined using the Perkin-Elmer/ABI 7700 Sequence Detection System which employs TaqMan technology.

To determine the level of 56634 in various human tissues a primer/probe set was designed. Total RNA was prepared from a series of human tissues using an RNeasy kit from Qiagen. First strand cDNA was prepared from 1 μg total RNA using an oligo-dT primer and Superscript II reverse transcriptase (Gibco/BRL). cDNA obtained from approximately 50 ng total RNA was used per TaqMan reaction. Tissues tested include the human tissues and several cell lines shown in Tables 5-12, below.

TaqMan analysis revealed that the expression of 56634 was increased with addition of the growth factor EGF to serum free culture media of the SKOV3 ovarian cancer cell line for 15, 30 or 60 minutes (Table 5). The expression of 56634 was also similarly increased when the breast cancer cell line MCF10A was treated with EGF for comparable time points (Table 6). 56634 was also shown to be induced in the HEY ovarian cell line with the addition of serum following overnight serum starvation (Table 7). When normal human ovarian epithelial cells (NOE) are compared with clinical ascites samples from several patients, 56634 was found to be upregulated in the ascites samples compared to the NOE (Table 8). Clinical data comparing expression of 56634 in solid tumor vs. normal tissue counterpart (Table 9), and expression in Phase I normal and diseased tissues (Table 10), all indicate that this gene is upregulated in tumor tissues compared to normal tissue counterparts. 56634 is also expressed in several xenograft friendly cell lines (Table 11).

TABLE 5

TaqMan expression of 56634 in EGF Treated SKOV3 (Ovarian Cancer) Cells

| Tissue Type | Expression |
| --- | --- |
| SKOV-3 No EGF | 4.6 |
| SKOV-3 EGF '15 | 5.7 |
| SKOV-3 EGF '30 | 7.1 |
| SKOV-3 EGF '60 | 5.3 |

TABLE 6

TaqMan expression of 56634 in EGF treated MCF10A cells (human breast cells)

| Tissue Type | Expression |
| --- | --- |
| MCF10A EGF 0 hr | 110.0 |
| MCF10A EGF 0.5 hr | 115.4 |
| MCF10A EGF 1 hr | 170.2 |
| MCF10A EGF 2 hr | 97.1 |
| MCF10A EGF 4 hr | 115.0 |
| MCF10A EGF 8 hr | 130.3 |

TABLE 7

Expression of 56634 in serum treated HEY (human ovarian cancer) cells.

| Tissue Type | Expression |
| --- | --- |
| HEY 0 hr | 5.0 |
| HEY 1 hr | 5.9 |
| HEY 3 hr | 7.8 |
| HEY 6 hr | 6.1 |
| HEY 9 hr | 5.6 |
| HEY 12 hr | 5.4 |

TABLE 8

TaqMan expression of 56634 in Clinical Ascites samples vs. NOE cells.

| Tissue Type | Expression |
| --- | --- |
| MDA 127 Normal Ovary | 1.5 |
| MDA 224 Normal Ovary | 0.5 |
| MDA 124 Ovarian Ascites | 1.8 |
| MDA 126 Ovarian Ascites | 5.1 |

TABLE 9

Oncology: Expression of 56634 in Normal (N), and Tumor (T), and metastatic (Met) Clinical Tissues

| Tissue Type | Expression |
| --- | --- |
| Breast N | 7.6 |
| Breast N | 3.8 |
| Breast N | 2.6 |
| Breast Tum: IDC-MD/PD | 31.6 |
| Breast T: IDC | 3.0 |
| Breast Tum: IDC-PD | 38.9 |
| Breast T: IDC | 1.5 |
| Breast T ILC (LG) | 10.5 |
| Lymph node (Breast met) | 0.0 |
| Lung (Breast met) | 1.5 |
| Ovary N | 2.5 |
| Ovary N | 1.9 |
| Ovary T: PD-PS | 6.4 |
| Ovary T: MD-PS | 2.7 |
| Ovary T: PD-PS | 13.0 |
| Ovary T: PD-AC | 2.1 |
| Ovary T: MD/PD-PS | 1.2 |
| Lung N | 0.7 |
| Lung N | 0.3 |
| Lung N | 3.1 |
| Lung T--SmC | 27.1 |
| Lung T: MD-SCC | 22.6 |
| Lung T: PD-NSCLC | 1.6 |
| Lung T: WD-AC | 21.7 |

TABLE 9-continued

Oncology: Expression of 56634 in Normal (N), and Tumor (T), and metastatic (Met) Clinical Tissues

| Tissue Type | Expression |
|---|---|
| Lung T: MD-AC | 19.4 |
| Lung T: MD-AC | 6.8 |
| Colon N | 4.7 |
| Colon N | 1.3 |
| Colon N | 1.1 |
| Colon T: MD | 22.4 |
| Colon T: MD | 44.0 |
| Colon T | 6.5 |
| Colon T: MD-PD | 34.2 |
| Colon-Liver Met | 6.6 |
| Colon-Liver Met | 3.8 |
| Liver N (female) | 0.1 |
| Cervix Squamous CC | 30.7 |
| Cervix Squamous CC | 2.0 |

TABLE 10

Phase I TaqMan expression of 56634 in Clinical Tissues

| Tissue Type | Expression |
|---|---|
| Artery normal | 13.5 |
| Aorta diseased | 0.0 |
| Vein normal | 0.6 |
| Coronary SMC | 1.1 |
| HUVEC | 0.7 |
| Hemangioma | 0.0 |
| Heart normal | 1.6 |
| Heart CHF | 1.6 |
| Kidney | 25.4 |
| Skeletal Muscle | 1.5 |
| Adipose normal | 0.0 |
| Pancreas | 0.0 |
| primary osteoblasts | 1.7 |
| Osteoclasts (diff) | 0.1 |
| Spinal cord normal | 0.8 |
| Brain Cortex normal | 208.0 |
| Nerve | 1.9 |
| DRG (Dorsal Root Ganglion) | 1.4 |
| Breast normal | 1.8 |
| Breast tumor | 1.6 |
| Ovary normal | 0.0 |
| Ovary Tumor | 0.0 |
| Prostate Normal | 5.4 |
| Prostate Tumor | 5.4 |
| Salivary glands | 1.8 |
| Colon normal | 0.5 |
| Colon Tumor | 2.0 |
| Lung normal | 0.0 |
| Lung tumor | 20.7 |
| Lung COPD | 0.6 |
| Colon IBD | 0.8 |
| Liver normal | 0.0 |
| Liver fibrosis | 0.0 |
| Spleen normal | 0.0 |
| Tonsil normal | 0.4 |
| Lymph node normal | 0.3 |
| Small intestine normal | 0.5 |
| Macrophages | 0.0 |
| Synovium | 0.0 |
| BM-MNC | 0.0 |
| Activated PBMC | 0.1 |
| Neutrophils | 0.0 |
| Megakaryocytes | 0.1 |
| Erythroid | 3.2 |
| positive control | 49.0 |
| Skin normal | 4.3 |
| Brain Hypothalamus normal | 2.8 |

TABLE 11

TaqMan expression of 56634 in various xenofriendly cell lines

| Tissue Type | Expression |
|---|---|
| MCF-7 Breast T | 270.7 |
| ZR75 Breast T | 243.2 |
| T47D Breast T | 327.6 |
| MDA 231 Breast T | 8.1 |
| MDA 435 Breast T | 8.4 |
| SKBr3 Breast | 15.6 |
| DLD 1 ColonT (stage C) | 476.3 |
| SW480 Colon T (stage B) | 39.7 |
| HCT116 | 16.8 |
| HT29 | 5.3 |
| Colo 205 | 1.0 |
| NCIH125 | 75.4 |
| NCIH67 | 51.3 |
| NCIH322 | 67.9 |
| NCIH460 | 12.5 |
| A549 | 56.3 |
| NHBE | 114.2 |
| SKOV-3 ovary | 1.6 |
| OVCAR-3 ovary | 38.6 |
| 293 Baby Kidney | 87.5 |
| 293T Baby Kidney | 120.7 |

In Situ Hybridization (ISH):

56634 was found to be expressed by ISH in ovarian, breast and colon tumor clinical samples. 56634 was localized to 0/3 normal ovary samples, 6/12 ovarian tumors, 2/2 normal breast, 4/4 breast tumors, 0/1 normal colon, 0/3 colon primary tumors, and 0/2 colon to liver metastases. See Table 12.

TABLE 12

In Situ Hybridization expression of 56634 in Clinical Human Tissues

| Spectrum | Tissue | Diagnosis | Results |
|---|---|---|---|
| Ovary: 0/3 Normal; 6/12 Tumor | | | |
| CHT 2438 | Ovary T | Tumor | (+/+) |
| CHT 2433 | Ovary T | Tumor | (++/+) |
| MDA 300 | Ovary T | Tumor | (−/−) |
| MDA 24 | Ovary T | Tumor | (+/−) |
| CLN 346 | Ovary T | Tumor | (−/−) |
| CHT 2431 | Ovary T | Tumor | (+/−) |
| CHT 2430 | Ovary T | Tumor | (−/−) |
| CHT 2432 | Ovary T | Tumor | (+/+) |
| CHT 2443 | Ovary T | Tumor | (−/−) |
| CHT 2429 | Ovary T | Tumor | (++/+) |
| MDA 222 | Ovary T | Tumor | (−/−) |
| CLN 356 | Ovary T | Tumor | (−/−) |
| CLN 572 | Ovary N | Normal ovarian stroma | (−/−) |
| CLN 571 | Ovary N | Normal ovarian stroma | (−/−) |
| CHT 619 | Ovary N | Normal ovarian stroma | (−/−) |
| Colon: 0/1 Normal; 0/3 Tumor; 0/2 Mets | | | |
| CHT 1877 | Colon T | Adenocarcinoma | (−/−) |
| CHT 1448 | Colon T | Adenocarcinoma | (−/−) |
| CHT 1855 | Colon T | Adenocarcinoma | (−/−) |
| CHT 755 | Colon M | Metastatic tumor to the liver with colonic origins | (−/−) |
| CHT 866 | Colon M | Metastatic tumor to the liver with colonic origins | (−/−) |
| NDR 209 | Colon N | Normal colonic epithelium | (−/−) |
| Breast: 0/1 Normal; 2/4 Tumor | | | |
| CHT 1874 | Breast T | IDC | (+/−) |
| NDR 134 | Breast T | IDC | (−/−) |
| CHT 1837 | Breast T | ILC | (−/−) |
| CLN 662 | Breast T | ILC | (++/−) |
| CHT 2248 | Breast N | Normal breast epithelial cells | (−/−) |

Human 55053 (EPK-55053)

The present invention is based, at least in part, on the discovery of a family of novel members of a family of molecules, referred to herein as "Eukaryotic Protein Kinase-55053" or "EPK-55053" nucleic acid and polypeptide molecules. Members of this family of molecules are able to participate in the modulation of the phosphorylation state of EPK-55053 substrate molecules. By doing so, these molecules are able to contribute to the regulation and/or modulation of the activity of these substrate molecules, and, hence, the biochemical pathways with which the substrates are associated.

Protein kinases and phosphatases play critical roles in the regulation of biochemical and morphological changes associated with cellular growth and division (D'Urso, G. et al. (1990) Science 250:786-791; Birchmeier, C. et al. (1993) Bioessays 15:185-189). They serve as growth factor receptors and signal transducers and have been implicated in cellular transformation and malignancy (Hunter, T. et al. (1992) Cell 70:375-387; Posada, J. et al. (1992) Mol. Biol. Cell 3:583-592; Hunter, T. et al. (1994) Cell 79:573-582). For example, protein kinases have been shown to participate in the transmission of signals from growth-factor receptors (Sturgill, T. W. et al. (1988) Nature 344:715-718; Gomez, N. et al. (1991) Nature 353:170-173), control of entry of cells into mitosis (Nurse, P. (1990) Nature 344:503-508; Maller, J. L. (1991) Curr. Opin. Cell Biol. 3:269-275) and regulation of actin bundling (Husain-Chishti, A. et al. (1988) Nature 334:718-721).

Protein kinases and phosphatases can be divided into different groups based on either amino acid sequence similarity or specificity for either serine/threonine or tyrosine residues. A small number of dual-specificity kinases and phosphatases have also been described. Within the broad classification, kinases and phosphatases can be further sub-divided into families whose members share a higher degree of catalytic domain amino acid sequence identity and also have similar biochemical properties. Most protein kinase and phosphatase family members also share structural features outside the kinase and phosphatase domain, respectively, that reflect their particular cellular roles. These include regulatory domains that control kinase or phosphatase activity or interaction with other proteins (Hanks, S. K. et al. (1988) Science 241:42-52).

In one embodiment, the EPK-55053 molecules of the present invention include at least one "transmembrane domain." As used herein, the term "transmembrane domain" includes an amino acid sequence of about 20-45 amino acid residues in length which spans the plasma membrane. More preferably, a transmembrane domain includes about at least 20, 25, 30, 35, 40, or 45 amino acid residues and spans the plasma membrane. Transmembrane domains are rich in hydrophobic residues, and typically have an alpha-helical structure. In a preferred embodiment, at least 50%, 60%, 70%, 80%, 90%, 95% or more of the amino acids of a transmembrane domain are hydrophobic, e.g., leucines, isoleucines, alanines, valines, phenylalanines, prolines or methionines. Transmembrane domains are described in, for example, Zagotta W. N. et al. (1996) Annu. Rev. Neurosci. 19:235-263, the contents of which are incorporated herein by reference. Amino acid residues 214-231 of the human EPK-55053 polypeptide (SEQ ID NO:11) comprise a transmembrane domain.

To identify the presence of a transmembrane domain in an EPK-55053 protein, and make the determination that a protein of interest has a particular profile, the amino acid sequence of the protein may be subjected to MEMSAT analysis. A MEMSAT analysis of the EPK-55053 protein set forth as SEQ ID NO:11 results in the identification of a transmembrane domain in the amino acid sequence of human EPK-55053 (SEQ ID NO:11) at about residues 214-231 (having a score of 4.1). Two other potential transmembrane domains were also identified at about amino acids 624-640 and 681-697 or SEQ ID NO:11.

In another embodiment, the EPK-55053 molecules of the present invention include at least one "eukaryotic protein kinase domain". As used herein, the term "eukaryotic protein kinase domain" includes a protein domain having at least about 150-350 amino acid residues and a bit score of at least 150 when compared against a eukaryotic protein kinase domain Hidden Markov Model (HMM), e.g., PFAM Accession Number PF00069. Preferably, a eukaryotic protein kinase domain includes a protein having an amino acid sequence of about 190-320, 210-300, 250-260 or more preferably about 252 amino acid residues, and a bit score of at least 150, 210, 250, 290, or more preferably, 323.4. To identify the presence of a eukaryotic protein kinase domain in an EPK-55053 protein, and make the determination that a protein of interest has a particular profile, the amino acid sequence of the protein may be searched against a database of known protein domains (e.g., the HMM database). The eukaryotic protein kinase domain has been assigned the PFAM Accession No. PF00069 (see the PFAM website, available through the University of Washington at St. Louis) and InterPro Accession No. IPR000719 (see the website for the European Bioinformatics Institute). A search was performed against the HMM database resulting in the identification of a eukaryotic protein kinase domain in the amino acid sequence of human EPK-55053 (SEQ ID NO:11) at about residues 34-285 of SEQ ID NO:11. The identified eukaryotic protein kinase domain is depicted as SEQ ID NO:14.

In another embodiment, the isolated nucleic acid molecules of the present invention encodes at least one "ubiquitin-associated domain" or "UBA domain". As used interchangeably herein, the terms "ubiquitin-associated domain" and "UBA domain" include a protein domain having at least about 10-70 amino acid residues when compared against a UBA domain Hidden Markov Model (HMM), e.g., PFAM Accession Number PF00627. Preferably, a UBA domain includes a protein having an amino acid sequence of about 10-70, 20-60, 30-50, 35-45 or more preferably about 40 amino acid residues, and a bit score of at least about 7.7. UBA domains (described in, for example, Diekmann et al. (1998) Nat. Struct. Biol. 5:1042-1047) are domains that belong to an extensive family of proteins which share a conserved sequence and which have associations with ubiquitin and the ubiquitination pathway. To identify the presence of a UBA domain in an EPK-55053 protein, and make the determination that a protein of interest has a particular profile, the amino acid sequence of the protein may be searched against a database of known protein domains (e.g., the HMM database). The UBA domain has been assigned the PFAM Accession No. PF00627 (see the PFAM website, available through the University of Washington at St. Louis) and InterPro Accession No. IPR000449 (see the website for the European Bioinformatics Institute). A search was performed against the HMM database resulting in the identification of a UBA domain in the amino acid sequence of human EPK-55053 (SEQ ID NO:11) at about residues 315-356 of SEQ ID NO:11. The identified UBA domain is depicted in SEQ ID NO:15.

To elucidate the substrate specificity of the HPK-55053 proteins of the present invention, further HMM analyses were performed using a proprietary database of Markov models, referred to herein as the SMART HMM database. This analysis resulted in the identification of a serine threonine kinase ("serkin_6") domain at about amino acids 34-285 of the human EPK-55053 amino acid sequence set forth as SEQ ID NO:11. Notably, this serine/threonine kinase domain overlaps almost exclusively with the protein kinase domain identified by HMM searching of the PFAM database, identifying the instant proteins as serine/threonine kinases as compared to tyrosine kinases. This analysis also resulted in the identification of a tyrosine kinase domain ("tyrkin_6") at about amino acid residues 34-286 of SEQ ID NO:11. The identified serkin_6 and tyrkin_6 domains are depicted in SEQ ID NO:16 and 17, respectively.

Moreover, a signature sequence which is specific for serine/threonine kinases (consensus sequence given as SEQ ID NO:13) was identified at about residues 152-164 of SEQ ID NO:11. This signature sequence occurs in the central part of the kinase catalytic domain of serine/threonine kinases and contains a conserved aspartate residue which is important for the catalytic activity of the enzyme (Knighton D. R. et al. (1991) *Science* 253:407-414). The consensus signature sequence described under the Prosite accession number PS00108 and is given as:

[LIVMFYC]-x-[HY]-x-D-[LIVMFY]-K-x (SEQ ID NO:13)
(2)-N-[LIVMFYCT](3)

A description of the Pfam database can be found in Sonhammer et al. (1997) *Proteins* 28:405-420 and a detailed description of HMMs can be found, for example, in Gribskov et al. (1990) *Methods Enzymol.* 183:146-159; Gribskov et al. (1987) *Proc. Natl. Acad. Sci. USA* 84:4355-4358; Krogh et al. (1994) *J. Mol. Biol.* 235:1501-1531; and Stultz et al. (1993) *Protein Sci.* 2:305-314, the contents of which are incorporated herein by reference.

In a preferred embodiment, the EPK-55053 molecules of the invention include at least one transmembrane domain and/or at least one eukaryotic protein kinase domain, and/or at least one UBA domain.

Isolated EPK-55053 polypeptides of the present invention, have an amino acid sequence sufficiently identical to the amino acid sequence of SEQ ID NO:11 or are encoded by a nucleotide sequence sufficiently identical to SEQ ID NO:10 or 12. As used herein, the term "sufficiently identical" refers to a first amino acid or nucleotide sequence which contains a sufficient or minimum number of identical or equivalent (e.g., an amino acid residue which has a similar side chain) amino acid residues or nucleotides to a second amino acid or nucleotide sequence such that the first and second amino acid or nucleotide sequences share common structural domains or motifs and/or a common functional activity. For example, amino acid or nucleotide sequences which share common structural domains having at least 60%, 65%, 70%, 75%, 76%, 80%, 85%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, 99.9% or more homology or identity across the amino acid sequences of the domains and contain at least one and preferably two structural domains or motifs, are defined herein as sufficiently identical. Furthermore, amino acid or nucleotide sequences which share at least 60%, 65%, 70%, 75%, 76%, 80%, 85%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, 99.9% or more homology or identity and share a common functional activity are defined herein as sufficiently identical.

In a preferred embodiment, an EPK-55053 polypeptide includes at least one or more of the following domains: a transmembrane domain, a eukaryotic protein kinase domain, a UBA domain, and has an amino acid sequence at least about 60%, 65%, 70%, 75%, 76%, 80%, 85%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, 99.9% or more homologous or identical to the amino acid sequence of SEQ ID NO:11. In yet another preferred embodiment, an EPK-55053 polypeptide includes at least one or more of the following domains: a transmembrane domain, a eukaryotic protein kinase domain, a UBA domain, and is encoded by a nucleic acid molecule having a nucleotide sequence which hybridizes under stringent hybridization conditions to a complement of a nucleic acid molecule comprising the nucleotide sequence of SEQ ID NO:10 or SEQ ID NO:12. In another preferred embodiment, an EPK-55053 polypeptide includes at least one or more of the following domains: a transmembrane domain, a eukaryotic protein kinase domain, a UBA domain, and has an EPK-55053 activity.

As used interchangeably herein, "EPK-55053 activity", "biological activity of EPK-55053" or "functional activity of EPK-55053", includes an activity exerted by an EPK-55053 polypeptide or nucleic acid molecule on an EPK-55053 responsive cell or tissue, or on an EPK-55053 polypeptide substrate, as determined in vivo, or in vitro, according to standard techniques. In one embodiment, an EPK-55053 activity is a direct activity, such as an association with an EPK-55053-target molecule. As used herein, a "target molecule" or "binding partner" is a molecule with which an EPK-55053 polypeptide binds or interacts in nature, such that EPK-55053-mediated function is achieved. An EPK-55053 target molecule can be a non-EPK-55053 molecule, for example, a non-EPK-55053 polypeptide. Additional, exemplary EPK-55053 target molecules can include lipid moieties, a lipid-associated moiety, or a nucleic acid. In another embodiment, an EPK-55053 activity is an indirect activity, such as a cellular signaling activity mediated by interaction of the EPK-55053 polypeptide with an EPK-55053 ligand.

In a preferred embodiment, an EPK-55053 polypeptide has one or more of the following activities: (1) interaction with an EPK-55053 substrate or target molecule (e.g., a non-EPK-55053 protein); (2) conversion of an EPK-55053 substrate or target molecule to a product (e.g., transfer of a phosphate group to a substrate or target molecule, or conversion of ATP to ADP); (3) interaction with and/or phosphate transfer to a second non-EPK-55053 protein; (4) modulation of intra- or intercellular signaling and/or gene transcription (e.g., either directly or indirectly); (5) modulation of the phosphorylation state of EPK-55053 target molecules (e.g., a kinase or a phosphatase molecule) or the phosphorylation state of one or more proteins involved in cellular growth, metabolism, or differentiation, e.g., cardiac, epithelial, or neuronal cell growth or differentiation, as described in, for example, Lodish H. et al., *Molecular Cell Biology* (Scientific American Books Inc., New York, N.Y., 1995) and Stryer L., *Biochemistry* (W.H. Freeman, New York), the contents of which are incorporated herein by reference; (6) modulation of the activity of one or more proteins involved in cellular growth or differentiation, e.g., cardiac, epithelial, or neuronal cell growth or differentiation; (7) modulation of expression of one or more genes (e.g., a transcription factor); (8) modulation of signal transduction; and (9) participation in immunoregulation.

In other preferred embodiments, the EPK-55053 polypeptides of the present invention have one or more of the following activities: (1) modulation of cancer or tumor progression; (2) modulation of cellular proliferation; (3) modulation of tissue development (e.g., embryogenesis); (4) modulation of differentiation; (5) modulation of apoptosis; (6) modulation of energy metabolism; and (7) modulation of a ubiquitination pathway. Thus, the EPK-55053 molecules of the present invention can participate in: (a) the regulation of transmission of signals from cellular receptors, e.g., growth factor receptors; (b) the modulation of the entry of cells into mitosis; (c) the modulation of cellular differentiation; (d) the modulation of cell death; (e) the regulation of cytoskeleton function, e.g., actin bundling; and (f) metabolic pathways and the regulation of metabolic pathways.

The EPK-55053 molecules, by participating in the regulation of phosphorylation states, provide novel diagnostic targets and therapeutic agents for controlling or treating a variety of kinase associated disorders. As used herein, the term "kinase associated disorder" include disorders, diseases, or conditions which are characterized by aberrant, e.g., upregulated, downregulated, or misregulated, protein kinase levels. In a preferred embodiment, a kinase associated disorder includes the inhibition or over-stimulation of the activity of kinases involved in signaling pathways associated with cellular growth can lead to perturbed cellular growth, which can in turn lead to cellular growth-related disorders. As used herein, a "cellular growth-related disorder", includes a disorder, disease, or condition characterized by a deregulation, e.g., an upregulation or a downregulation, of cellular growth. Cellular growth deregulation may be due to a deregulation of cellular proliferation, cell cycle progression, cellular differentiation and/or cellular hypertrophy. Examples of cellular growth related disorders include cardiovascular disorders such as heart failure, hypertension, atrial fibrillation, dilated cardiomyopathy, idiopathic cardiomyopathy, or angina; proliferative disorders or differentiative disorders such as cancer, e.g., melanoma, prostate cancer, cervical cancer, breast cancer, colon cancer, or sarcoma.

Other examples of EPK-55053 associated disorders include CNS disorders, cardiac-related disorders (cardiovascular disorders), disorders of the musculoskeletal system, hormonal disorders, immune disorders, such as autoimmune disorders or immune deficiency disorders, e.g., congenital X-linked infantile hypogammaglobulinemia, transient hypogammaglobulinemia, common variable immunodeficiency, selective IgA deficiency, chronic mucocutaneous candidiasis, or severe combined immunodeficiency.

EPK-55053 associated or related disorders also include disorders affecting tissues in which EPK-55053 protein is expressed.

Isolation of the Human EPK-55053 cDNA

The invention is based, at least in part, on the discovery of a human gene encoding a novel 85.6 kD polypeptide, referred to herein as human EPK-55053. The entire sequence of the human clone 55053 was determined and found to contain an open reading frame termed human "EPK-55053." The nucleotide sequence of the human EPK-55053 gene contains 2980 nucleic acids and is set forth in the Sequence Listing as SEQ ID NO:10. The amino acid sequence of the human EPK-55053, containing 778 amino acids, is set forth in the Sequence Listing as SEQ ID NO:11. The coding region (open reading frame) of SEQ ID NO:10 is set forth as SEQ ID NO:12.

Analysis of the Human EPK-55053 Molecules

A search using the polypeptide sequence of SEQ ID NO:11 was performed against the HMM database in PFAM resulting in the identification of a eukaryotic protein kinase domain in the amino acid sequence of human EPK-55053 at about residues 34-285 of SEQ ID NO:11 (score=323.4). Searching the SMART HMM database resulted in the further identification of this domain as a serine threonine kinase domain. The identified eukaryotic protein kinase domain and serine threonine kinase domain are depicted as SEQ ID NO:14, 16 and 17.

This search also resulted in the identification of a UBA domain in the amino acid sequence of human EPK-55053 at about residues 315-356 of SEQ ID NO:11 (score=7.7). The identified UAB domain is depicted as SEQ ID NO:15.

A search using the polypeptide sequence of SEQ ID NO:11 was also performed against the MEMSAT database, resulting in the identification of potential transmembrane domains (score=4.1) in the amino acid sequence of human EPK-55053 (SEQ ID NO:11) at about residues 214-231, 624-640, and 681-697.

Searches of the amino acid sequence of human EPK-55053 were further performed against the Prosite database. These searches resulted in the identification in the amino acid sequence of human EPK-55053 of a potential cAMP/cGMP-dependant protein kinase phosphorylation site (ProSite Accession No. PS00004) at about residues 272-275 of SEQ ID NO:11. A glycosaminoglycan attachment site (ProSite Accession No. PS00002) was also identified at about residues 682-685 of SEQ ID NO:11. Fifteen potential protein kinase C phosphorylation sites (ProSite Accession No. PS00005) were identified at about residues 129-131, 417-419, 427-429, 447-449, 472-474, 496-498, 508-510, 523-525, 555-557, 563-565, 619-621, 643-645, 676-678, 699-701, and 758-760 of SEQ ID NO:11. Twelve potential casein kinase II sites (ProSite Accession No. PS00006) were identified at about residues 114-117, 129-132, 142-145, 185-188, 311-314, 341-344, 363-366, 404-407, 575-578, 586-589, 668-671, and 715-718 of SEQ ID NO:11. Eleven potential N-myristoylation sites (ProSite Accession No. PS00008) were identified at about residues 4-9, 10-15, 57-62, 435440, 485490, 507-512, 530-535, 541-546, 597-602, and 681-686 of SEQ ID NO:11. Three amidation sites (ProSite Accession No. PS00009) were identified at about residues 208-211, 300-303, and 390-393 of SEQ ID NO:11. Most notably, a serine/threonine protein kinase active site signature (ProSite Accession No. PS00108) was identified at about residues 152-164 of SEQ ID NO:11.

The amino acid sequence of human EPK-55053 was analyzed using the program PSORT (available online; see Nakai, K. and Kanehisa, M. (1992) *Genomics* 14:897-911) to predict the localization of the proteins within the cell. This program assesses the presence of different targeting and localization amino acid sequences within the query sequence. The results of the analyses show that human EPK-55053 may be localized to the cytoplasm, nucleus, or mitochondria.

Further homologies of interest were identified by using the amino acid sequence of EPK-55053 (SEQ ID NO:11) to search the ProDom database (available through the Institute National de la Recherche Agronomique, France). This search resulted in the identification of homology in the amino acid sequence of human EPK-55053 to a yeast probable serine/threonine protein kinase, a hypothetical 169.2 kD protein, a transmembrane kinase protein, a putative NPK-1 kinase, a *C. elegans* serine/threonine protein kinase, and HRPOPK-1 protein.

Human 2504, 15977 and 14760

The present invention is based, in part, on the discovery of novel protein kinase family members, referred to herein as "2504, 15977, and 14760". The nucleotide sequence of a cDNA encoding 2504 is shown in SEQ ID NO:18, and the amino acid sequence of a 2504 polypeptide is shown in SEQ ID NO:19. In addition, the nucleotide sequence of the 2504 coding region is depicted in SEQ ID NO:20. The nucleotide sequence of a cDNA encoding 15977 is shown in SEQ ID NO:21, and the amino acid sequence of a 15977 polypeptide is shown in SEQ ID NO:22. In addition, the nucleotide sequence of the 15977 coding region is depicted in SEQ ID NO:23. The nucleotide sequence of a cDNA encoding 14760 is shown in SEQ ID NO:24, and the amino acid sequence of a 14760 polypeptide is shown in SEQ ID NO:25. In addition, the nucleotide sequence of the 14760 coding region is depicted in SEQ ID NO:26.

Human 2504

The human 2504 sequence (SEQ ID NO:18), which is approximately 2297 nucleotides long including untranslated regions, contains a predicted methionine-initiated coding sequence of about 1503 nucleotides (nucleotides 154-1656 of SEQ ID NO:18; SEQ ID NO:20). The coding sequence encodes a 501 amino acid protein (SEQ ID NO:19).

This mature protein form is approximately 501 amino acid residues in length (from about amino acid 1 to amino acid 501 of SEQ ID NO:19). Human 2504 contains the following regions or other structural features: a eukaryotic protein kinase domain (PFAM Accession PF00069) located at about amino acid residues 37 to 286 of SEQ ID NO:19; and a serine/threonine kinase domain located at about amino acid residues 24 to 286 of SEQ ID NO:19.

The 2504 protein also includes the following domains: twelve predicted Protein Kinase C phosphorylation sites (PS00005) located at about amino acids 21 to 23, 46-48, 51-53, 91-93, 103-105, 118-120, 138-140, 292-294, 422-424, 482-484, and 495-497 of SEQ ID NO:19; ten predicted Casein Kinase II phosphorylation sites (PS00006) located at about amino 7-10, 91-94, 103-106, 118-121, 276-279, 341-344, 364-367, 470-473, 483-486, and 495-498 of SEQ ID NO:19; two predicted tyrosine kinase phosphorylation sites (PS00007) located at about amino acids 127-135 and 484-491 of SEQ ID NO:19; two predicted N-myristoylation sites (PS00008) located at about amino acids 288-293 and 349-354 of SEQ ID NO:19; and one predicted amidation site located at about amino acids 59-62 of SEQ ID NO:19.

For general information regarding PFAM identifiers, PS prefix and PF prefix domain identification numbers, refer to Sonnhammer et al. (1997) *Protein* 28:405-420.

Human 15977

The human 15977 sequence (SEQ ID NO:21), which is approximately 4417 nucleotides long including untranslated regions, contains a predicted methionine-initiated coding sequence of about 1377 nucleotides (nucleotides 337-1713 of SEQ ID NO:21; SEQ ID NO:23). The coding sequence encodes a 459 amino acid protein (SEQ ID NO:22).

This mature protein form is approximately 459 amino acid residues in length (from about amino acid 1 to amino acid 459 of SEQ ID NO:22). Human 15977 contains the following regions or other structural features: a eukaryotic protein kinase domain (PFAM Accession PF00069) located at about amino acid residues 44 to 276 of SEQ ID NO:22; and a serine/threonine kinase domain located at about amino acid residues 44 to 329 of SEQ ID NO:22.

The 15977 protein also includes the following domains: two predicted N-glycosylation sites (PS00001) located at about amino acids 370-373 and 388-391 of SEQ ID NO:22; two cAMP- and cGMP-dependent protein kinase phosphorylation sites (PS00004) located at about amino acids 270-273 and 451-454 of SEQ ID NO:22; nine predicted Protein Kinase C phosphorylation sites (PS00005) located at about amino acids 14-16, 137-139, 199-201, 214-216, 229-231, 258-260, 269-271, 355-357, and 373-375 of SEQ ID NO:22; eight predicted Casein Kinase II sites (PS00006) located at about amino 96-99, 124-127, 150-153, 229-232, 258-261, 273-276, 355-358, and 411-414 of SEQ ID NO:22; two predicted N-myristoylation sites (PS00008) located at about amino 30-35 and 422-427 of SEQ ID NO:22; one predicted amidation site (PS00009) located at about amino acids 46-49 of SEQ ID NO:22; and a Serine/Threonine protein kinase active-site signature (PS 00108) located at about amino acids 160-172 of SEQ ID NO:22.

For general information regarding PFAM identifiers, PS prefix and PF prefix domain identification numbers, refer to Sonnhammer et al. (1997) *Protein* 28:405-420.

Human 14760

The human 14760 sequence (SEQ ID NO:24), which is approximately 2046 nucleotides long including untranslated regions, contains a predicted methionine-initiated coding sequence of about 1788 nucleotides (nucleotides 119-1906 of SEQ ID NO:24; SEQ ID NO:26). The coding sequence encodes a 596 amino acid protein (SEQ ID NO:25).

This mature protein form is approximately 596 amino acid residues in length (from about amino acid 1 to amino acid 596 of SEQ ID NO:25). Human 14760 contains the following regions or other structural features: a eukaryotic protein kinase domain (PFAM Accession PF00069) located at about amino acid residues 285 to 540 of SEQ ID NO:25; and a serine/threonine kinase domain located at about amino acid residues 285 to 540 of SEQ ID NO:25.

The 14760 protein also includes the following domains: two predicted N-glycosylation sites (PS00001) located at about amino acids 278-281 and 416-419 of SEQ ID NO:25; three cAMP- and cGMP-dependent protein kinase phosphorylation sites (PS00004) located at about amino acids 140-143, 317-320, and 583-586 SEQ ID NO:25; eleven predicted Protein Kinase C phosphorylation sites (PS00005) located at about amino acids 17-19, 49-51, 59-61, 107-109, 159-161, 203-205, 224-226, 235-237, 247-249, 320-322, and 460-462 of SEQ ID NO:25; eight predicted Casein Kinase II phosphorylation sites (PS00006) located at about amino 157-160, 184-187, 203-206, 247-250, 301-304, 320-323, 351-354, and 379-382 of SEQ ID NO:25; one predicted tyrosine kinase phosphorylation sites (PS00007) located at about amino acids 370-376 of SEQ ID NO:25; nine predicted N-myristoylation sites (PS00008) located at about amino acids 83-88, 116-121, 135-140, 178-183, 241-246, 277-282, 293-298, 308-313, and 589-594 of SEQ ID NO:25; one predicted amidation site (PS00009) located at about amino acids 128-131 of SEQ ID NO:25; a protein kinases ATP-binding region signature located at about amino acids 291-299 of SEQ ID NO:25; and a Serine/Threonine protein kinase active-site signature (PS 00108) located at about amino acids 402-414 of SEQ ID NO:25.

For general information regarding PFAM identifiers, PS prefix and PF prefix domain identification numbers, refer to Sonnhammer et al. (1997) *Protein* 28:405-420.

TABLE 13

Summary of Domains of 2504, 15977, and 14760

| Protein | Protein Kinase Domain | Serine/Threonine Kinase Domain |
|---|---|---|
| 2504 | About amino acids 37-286 of SEQ ID NO: 19 | About amino acids 24-286 of SEQ ID NO: 19 |
| 15977 | About amino acids 44-276 of SEQ ID NO: 22 | About amino acids 44-329 of SEQ ID NO: 22 |
| 14760 | About amino acids 285-540 of SEQ ID NO: 25 | About amino acids 285-540 of SEQ ID NO: 25 |

The 2504, 15977, and 14760 proteins contains a significant number of structural characteristics in common with members of the protein kinase family. The term "family" when referring to the protein and nucleic acid molecules of the invention means two or more proteins or nucleic acid molecules having a common structural domain or motif and having sufficient amino acid or nucleotide sequence homology as defined herein. Such family members can be naturally or non-naturally occurring and can be from either the same or different species. For example, a family can contain a first protein of human origin as well as other distinct proteins of human origin, or alternatively, can contain homologues of non-human origin, e.g., rat or mouse proteins. Members of a family can also have common functional characteristics.

A 2504, 15977, or 14760 polypeptide can include a "protein kinase domain" or regions homologous with a "protein kinase domain".

As used herein, the term "protein kinase" includes a protein or polypeptide which is capable of modulating its own phosphorylation state or the phosphorylation state of another protein or polypeptide. Protein kinases play critical roles in the regulation of biochemical and morphological changes associated with cellular growth and division (D'Urso, G. et al. (1990) Science 250: 786-791; Birchmeier. C. et al. (1993) Bioessays 15: 185-189). They serve as growth factor receptors and signal transducers and have been implicated in cellular transformation and malignancy (Hunter, T. et al. (1992) Cell 70: 375-387; Posada, J. et al. (1992) Mol. Biol. Cell 3: 583-592; Hunter, T. et al. (1994) Cell 79: 573-582). For example, protein kinases have been shown to participate in the transmission of signals from growth-factor receptors (Sturgill, T. W. et al. (1988) Nature 344: 715-718; Gomez, N. et al. (1991) Nature 353: 170-173), control of entry of cells into mitosis (Nurse, P. (1990) Nature 344: 503-508; Maller, J. L. (1991) Curr. Opin. Cell Biol. 3: 269-275) and regulation of actin bundling (Husain-Chishti, A. et al. (1988) Nature 334: 718-721).

Protein kinases can have a specificity for (i.e., a specificity to phosphorylate) serine/threonine residues, tyrosine residues, or both serine/threonine and tyrosine residues, e.g., the dual specificity kinases. As referred to herein, protein kinases preferably include a catalytic domain of about 200-400 amino acid residues in length, preferably about 200-300 amino acid residues in length, or more preferably about 250-300 amino acid residues in length. Specificity of a protein kinase for phosphorylation of either tyrosine or serine/threonine can be predicted by the sequence of two of the subdomains (VIb and VIII) in which different residues are conserved in each class (as described in, for example, Hanks et al. (1988) Science 241:42-52) the contents of which are incorporated herein by reference). These subdomains are also described in further detail herein.

Protein kinases play a role in signaling pathways associated with cellular growth. For example, protein kinases are involved in the regulation of signal transmission from cellular receptors, e.g., growth-factor receptors; entry of cells into mitosis; and the regulation of cytoskeleton function, e.g., actin bundling. Thus, the molecules of the present invention may be involved in: 1) the regulation of transmission of signals from cellular receptors, e.g., cell growth factor receptors; 2) the modulation of the entry of cells, e.g., precursor cells, into mitosis; 3) the modulation of cellular differentiation; 4) the modulation of cell death; and 5) the regulation of cytoskeleton function, e.g., actin bundling.

Inhibition or over stimulation of the activity of protein kinases involved in signaling pathways associated with cellular growth can lead to perturbed cellular growth, which can in turn lead to cellular growth related disorders. As used herein, a "cellular growth related disorder" includes a disorder, disease, or condition characterized by a deregulation, e.g., an upregulation or a downregulation, of cellular growth. Cellular growth deregulation may be due to a deregulation of cellular proliferation, cell cycle progression, cellular differentiation and/or cellular hypertrophy. Examples of cellular growth related disorders include cardiovascular disorders such as heart failure, hypertension, atrial fibrillation, dilated cardiomyopathy, idiopathic cardiomyopathy, or angina; proliferative disorders or differentiative disorders such as cancer, e.g., melanoma, prostate cancer, cervical cancer, breast cancer, colon cancer, or sarcoma.

As used herein, the term "protein kinase domain" includes an amino acid sequence of about 150 to 400 amino acid residues in length and having a bit score for the alignment of the sequence to the protein kinase domain (HMM) of at least 50. Preferably, a protein kinase domain includes at least about 200-400 amino acids, more preferably about 200-300 amino acid residues, or about 220-270 amino acids and has a bit score for the alignment of the sequence to the protein kinase domain (HMM) of at least 120 or greater. The protein kinase domain (HMM) has been assigned the PFAM Accession PF00069. An alignment of the protein kinase domain (amino acids 37 to 286 of SEQ ID NO:19) of human 2504 with a consensus amino acid sequence derived from a hidden Markov model yields a score of 229.1 (E=6.5e-65). The identified protein kinase domain of 2504 is depicted in SEQ ID NO:27. An alignment of the protein kinase domain (amino acids 44 to 276 of SEQ ID NO:22) of human 15977 with a consensus amino acid sequence derived from a hidden Markov model yields a score of 123.3 (E=4.3e-33). The identified protein kinase domain of 15977 is depicted in SEQ ID NO:29. An alignment of the protein kinase domain (amino acids 285 to 540 of SEQ ID NO:25) of human 14760 with a consensus amino acid sequence derived from a hidden Markov model yields a score of 251.1 (E=1.5e-71). The identified protein kinase domain of 2504 is depicted in SEQ ID NO:30.

In a preferred embodiment 2504, 15977, or 14760 polypeptide or protein has a "protein kinase domain" or a region which includes at least about 200-400 more preferably about 200-300 or 220-270 amino acid residues and has at least about 70% 80% 90% 95%, 99%, or 100% homology with a "protein kinase domain," e.g., the protein kinase domain of human 2504, 15977, or 14760 (e.g., residues 37-286 of SEQ ID NO:19; residues 44-276 of SEQ ID NO:22, or residues 285-540 of SEQ ID NO:25).

A 2504, 15977, or 14760 molecule can further include a "serine/threonine kinase domain."

As used herein, the term "serine/threonine kinase domain" includes an amino acid sequence of about 150 to 400 amino acid residues in length and having a bit score for the alignment of the sequence to the protein kinase domain (HMM) of at least 15. Preferably, a serine/threonine kinase domain includes at least about 200-400 amino acids, more preferably about 200-300 amino acid residues, or about 220-270 amino acids and has a bit score for the alignment of the sequence to the serine/threonine kinase domain (HMM) of at least 50 or greater. An alignment of the serine/threonine kinase domain (amino acids 24 to 286 of SEQ ID NO:19) of human 2504 with a consensus amino acid sequence derived from a hidden Markov model yields a score of 284.1 (E=1.8e-81). An alignment of the serine/threonine kinase domain (amino acids 44 to 329 of SEQ ID NO:22) of human 15977 with a consensus amino acid sequence derived from a hidden Markov model yields a score of 64.9 (E=1.8e-15). An alignment of the serine/threonine kinase domain (amino acids 285 to 540 of SEQ ID NO:25) of human 14760 with a consensus amino acid sequence derived from a hidden Markov model yields a score of 296.2 (E=4e-85). The identified serine/threonine kinase domains in 2504, 15977 and 14760 is depicted in SEQ ID NO:28.

In a preferred embodiment 2504, 15977, or 14760 polypeptide or protein has a "serine/threonine kinase domain" or a region which includes at least about 200-400 more preferably about 200-300 or 220-270 amino acid residues and has at least about 70% 80% 90% 95%, 99%, or 100% homology with a "serine/threonine kinase domain," e.g., the serine/threonine kinase domain of human 2504, 15977, or 14760 (e.g., residues 24-286 of SEQ ID NO:19; residues 44-329 of SEQ ID NO:22, or residues 285-540 of SEQ ID NO:25).

To identify the presence of a "protein kinase" domain or a "serine/threonine kinase" domain in a 2504, 15977, or 14760 protein sequence, and make the determination that a polypeptide or protein of interest has a particular profile, the amino acid sequence of the protein can be searched against a database of HMMs (e.g., the Pfam database, release 2.1) using the default parameters. For example, the hmmsf program, which is available as part of the HMMER package of search programs, is a family specific default program for MILPAT0063 and a score of 15 is the default threshold score for determining a hit. Alternatively, the threshold score for determining a hit can be lowered (e.g., to 8 bits). A description of the Pfam database can be found in Sonhammer et al. (1997) *Proteins* 28(3):405-420 and a detailed description of HMMs can be found, for example, in Gribskov et al. (1990) *Meth. Enzymol.* 183:146-159; Gribskov et al. (1987) *Proc. Natl. Acad. Sci. USA* 84:4355-4358; Krogh et al. (1994) *J. Mol. Biol.* 235: 1501-1531; and Stultz et al. (1993) *Protein Sci.* 2:305-314, the contents of which are incorporated herein by reference.

A 2504, 15977, or 14760 family member can include a protein kinase domain, e.g. a serine/threonine kinase domain.

As the 2504, 15977, or 14760 polypeptides of the invention may modulate 2504, 15977, or 14760-mediated activities, they may be useful as of for developing novel diagnostic and therapeutic agents for 2504, 15977, or 14760-mediated or related disorders, as described below.

As used herein, a "2504, 15977, or 14760 activity", "biological activity of 2504, 15977, or 14760" or "functional activity of 2504, 15977, or 14760", refers to an activity exerted by a 2504, 15977, or 14760 protein, polypeptide or nucleic acid molecule on e.g., a 2504, 15977, or 14760-responsive cell or on a 2504, 15977, or 14760 substrate, e.g., a protein substrate, as determined in vivo or in vitro. In one embodiment, a 2504, 15977, or 14760 activity is a direct activity, such as an association with a 2504, 15977, or 14760 target molecule. A "target molecule" or "binding partner" is a molecule with which a 2504, 15977, or 14760 protein binds or interacts in nature, e.g., a protein containing one or more serine and or threonine residues. A 2504, 15977, or 14760 activity can also be an indirect activity, e.g., a cellular signaling activity mediated by interaction of the 2504, 15977, or 14760 protein with a 2504, 15977, or 14760 receptor. For example, the 2504, 15977, or 14760 proteins of the present invention can have one or more of the following activities: 1) the regulation of transmission of signals from cellular receptors, e.g., cell growth factor receptors; 2) the modulation of the entry of cells, e.g., precursor cells, into mitosis; 3) the modulation of cellular differentiation; 4) the modulation of cell death; 5) the regulation of cytoskeleton function, e.g., actin bundling; or 6) the ability to phosphorylate a substrate.

Based on the above-described sequence similarities, the 2504, 15977, and 14760 molecules of the present invention are predicted to have similar biological activities as protein kinase family members. Thus, the 2504, 15977, and 14760 molecules can act as novel diagnostic targets and therapeutic agents for controlling one or more of cellular proliferative and/or differentiative disorders, disorders associated with bone metabolism, immune disorders, hematopoietic disorders, cardiovascular disorders, liver disorders, viral diseases, pain or metabolic disorders.

In addition, the 2504, 15977, and 14760 molecules of the invention may modulate physiological and pathological processes in the cells or tissues where they are expressed. For example, Taq Man studies described herein show abundant expression of 2504, 15977, and 14760 mRNAs in neural tissues, including the brain cortex and hypothalamus. 15977 mRNA is also highly expressed in epithelial cells, astrocytes (glial cells), HUVEC cells, smooth muscle cells and fetal liver. 14760 mRNA is also abundantly expressed in the fetal liver, endothelial cells, fetal heart, fibroblasts, bone marrow glycophorin-positive cells, hepatocytes, cardiovascular cells, and skeletal muscle. Accordingly, these molecules can act as novel diagnostic targets and therapeutic agents of disorders involving the cells or tissues where they are expressed, e.g., neural (e.g., brain or astrocytic) disorders; cardiovascular and blood vessel (smooth muscle or endothelial cell) disorders; immune disorders (e.g., disorders involving glycophorin-positive cells); hepatic or liver disorders; skin disorders; skeletal disorders, among others.

Identification and Characterization of Human 2504, 15977, or 14760 cDNA and Genomic Sequence The human 2504 sequence (SEQ ID NO:18), which is approximately 2297 nucleotides long including untranslated regions, contains a predicted methionine-initiated coding sequence of about 1503 nucleotides (nucleotides 154-1656 of SEQ ID NO:18; SEQ ID NO:20). The coding sequence encodes a 501 amino acid protein (SEQ ID NO:19).

The human 15977 sequence (SEQ ID NO:21), which is approximately 4417 nucleotides long including untranslated regions, contains a predicted methionine-initiated coding sequence of about 1377 nucleotides (nucleotides 337-1713 of SEQ ID NO:21; SEQ ID NO:23). The coding sequence encodes a 459 amino acid protein (SEQ ID NO:22).

The human 14760 sequence (SEQ ID NO:24), which is approximately 2046 nucleotides long including untranslated regions, contains a predicted methionine-initiated coding sequence of about 1788 nucleotides (nucleotides 119-1906 of SEQ ID NO:24; SEQ ID NO:26). The coding sequence encodes a 596 amino acid protein (SEQ ID NO:25).

Tissue Distribution of 2504, 15977, or 14760 mRNA

Endogenous human 2504, 15977, and 14760 gene expression was determined using the Perkin-Elmer/ABI 7700 Sequence Detection System which employs TaqMan technology.

To determine the level of 2504, 15977, and 14760 in various human tissues a primer/probe set was designed using Primer Express (Perkin-Elmer) software and primary cDNA sequence information. Total RNA was prepared from a series of human tissues using an RNeasy kit from Qiagen. First strand cDNA was prepared from 1 µg total RNA using an oligo-dT primer and Superscript II reverse transcriptase (Gibco/BRL). cDNA obtained from approximately 50 ng total RNA was used per TaqMan reaction. 2504, 15977, and 14760 mRNA levels were analyzed in a variety of samples of human tissues Relative 2504 mRNA expression was determined by Taq-Man assays on mRNA derived from the following tissues: monkey cortex; monkey dorsal root ganglion; monkey spinal cord; monkey sciatic nerve; monkey kidney; monkey hairy skin; monkey heart left ventricle; monkey gastro muscle; monkey liver; human brain; human spinal cord; human heart; human kidney; human liver; and human lung. The highest 2504 mRNA expression was observed in monkey cortex, human brain, and monkey and human spinal cords.

Relative 15977 mRNA expression was determined by Taq-Man assays on mRNA derived from the following human tissues: (1) Aorta/normal; (2) Fetal heart/normal; (3) Heart normal; (4) Heart/congestive heart failure (CHF); (5) Vein/Normal; (6) Smooth muscle cells (SMC) (Aortic); (7) Spinal cord/Normal; (8) Brain cortex/Normal; (9) Brain hypothalamus/Normal; (10) Glial cells (Astrocytes); (11) Brain/Glioblastoma; (12) Breast/Normal; (13) Breast tumor/(invasive carcinoma (IDC); (14) Ovary/Normal; (15) Ovary/Tumor; (16) Pancreas; (17) Prostate/Normal; (18) Prostate/Tumor; (19) Colon/normal; (20) Colon/tumor; (21) Colon/IBD; (22) Kidney/normal; (23) Liver/normal; (24) Liver fibrosis; (25) Fetal Liver/normal; (26) Lung/normal; (27) Lung/tumor; (28) Lung/COPD; (29) Spleen/normal; (30) Tonsil/normal; (31) Lymph node/normal; (32) Thymus/normal; (33) Epithelial Cells (prostate); (34) Endothelial Cells (aortic); (35) Skeletal Muscle/Normal; (36) Fibroblasts (Dermal); (37) Skin/normal; (38) Adipose/Normal; (39) Osteoblasts (primary); (40) Osteoblasts (undifferentiated); (41) Osteoblasts (Diff); (42) Osteoclasts; (43) Aortic smooth muscle cells (SMC) Early; (44) Aortic SMC Late; (45) Shear human umbilical vein endothelial cells (HUVEC); and (46) Static HUVEC. Elevated 15977 mRNA expression was observed in epithelial cells, astrocytes (glial cells), normal brain (e.g., cortex and hypothalamus), HUVEC, and normal fetal liver.

Relative 14760 mRNA expression was determined by Taq-Man assays on mRNA derived from the following human tissues: (1) Aorta/Normal; (2) Fetal Heart/Normal; (3) Heart/Normal; (4) Heart/CHF; (5) Vein/Normal; (6) SMC/aortic; (7) Nerve; (8) Spinal Cord/Normal; (9) Brain Cortex/Normal; (10) Brain hypothalamus; (11) Glial Cells (astrocytes); (12) Glioblastoma; (13) Breast/Normal; (14) Breast/IDC; (15) Ovary/Normal; (16) Ovary/Tumor; (17) Pancreas; (18) Prostate/Normal; (19) Prostate/tumor adenocarcinoma; (20) Colon/Normal; (21) Colon/Tumor; (22) Colon/IBD; (23) Kidney/Normal; (24) Liver/Normal; (25) Liver/Fibrosis; (26) Fetal Liver/Normal; (27) Lung/Normal; (28) COPD; (29) Spleen/Normal; (30) Tonsil/Normal; (31) Lymph Node/Normal; (32) Thymus/Normal; (33) Epithelial Cells; (34) Endothelial cells; (35) Skeletal Muscle/Normal; (36) Fibroblasts; (37) Skin/Normal; (38) Adipose/normal; (39) Osteoblast/Primary; (40) Osteoblast/undifferentiated; (41) Osteoblast/differentiated; and (42) Osteoclasts. Elevated 14760 mRNA expression was observed in normal brain (e.g., cortex and hypothalamus), and normal fetal liver and fetal heart.

Relative 14760 mRNA expression was determined by Taq-Man assays on mRNA derived from the following tissues and cell lines: (1) Heart; (2) Lung; (3) Kidney; (4) Fetal Liver; (5) Spleen; (6) Granulocytes.; (7) NHDF mock; (8) NHLF mock; (9) NHLF TGF; (10) HepG2 Mock; (11) HepG2 TGF; (12) Pass Stell; (13) Liver Pool; (14) Control liver; (15) LF/NDR 191; (16) LF/NDR 193; (17) LF/NDR 079; (18) LN NDR 173; (19) Tonsil; (20) TH124 hr. MP39; (21) TH2 24 hr. MP39; (22) TH124 hr. MP21; (23) TH2 24 hr. MP21; (24) CD4; (25) CD8; (26) CD19; (27) CD3 MP42 rest; (28) CD14; (29) PBMC MOCK; (30) Bone marrow mononuclear cells (BM MNC); (31) CD34-positive cells (MPB CD34+); (32) Bone marrow glycophorin-positive cells (BM GPA+); (33) Cord Blood; (34) Erythroid; (35) Megakaryocytes; (36) Neutrophils (Neut) after 14 days in culture (d14); (37) CD14−/CD15+; (38) MBM CD11b; (39) HepG2; (40) HepG2.2.15; (41) MAI 01; (42) HL60; (43) K562; (44) Molt 4; (45) Hep3B Normoxia; and (46) Hep3B Hypoxia. Elevated 14760 mRNA expression was observed in pass stell, bone marrow glycophorin-positive cell lines, MOLT-4 cell lines and fetal liver.

Relative 14760 mRNA expression was determined using a cardiovascular organ panel by TaqMan assays on mRNA derived from the following cardiovascular tissues: normal atria; normal left ventricle; diseased right ventricle; diseased left ventricle; kidney; liver; and skeletal muscle. Elevated 14760 mRNA expression was observed in skeletal muscle and cardiovascular tissues.

Human 25501

The invention is based, at least in part, on the discovery of a novel transferase referred to herein as "25501". The human 25501 sequence (SEQ ID NO:31), which is approximately 1971 nucleotides long including untranslated regions, contains a predicted methionine-initiated coding sequence of about 1512 nucleotides, including the termination codon (nucleotides indicated as coding of SEQ ID NO:31; SEQ ID NO:33). The coding sequence encodes a 503 amino acid protein (SEQ ID NO:32).

Human 25501 contains the following regions or other structural features (for general information regarding PFAM identifiers, PS prefix and PF prefix domain identification numbers, refer to Sonnhammer et al. (1997) *Protein* 28:405-420: a transfer domain (ProDom No. PD034341, SEQ ID NO:34) located at about amino acid residues 280 to 411 of SEQ ID NO:32; a recognition/binding domain located at about amino acid residues 30 to 250 of SEQ ID NO:32; six protein kinase C phosphorylation sites (Prosite PS00005) located at about amino acids 47 to 49, 126 to 128, 178 to 180, 181 to 183, 206 to 208, and 210 to 212 of SEQ ID NO:32; ten casein kinase II phosphorylation sites (Prosite PS00006) located at about amino acids 10 to 13, 41 to 44, 54 to 57, 126 to 129, 179 to 182, 222 to 225, 292 to 295, 357 to 360, 431 to 434, and 456 to 459 of SEQ ID NO:32; one cAMP/cGMP-dependent protein kinase phosphorylation site (Prosite PS00004) located at about amino acids 414 to 417 of SEQ ID NO:32; one tyrosine kinase phosphorylation site (Prosite PS00007) located at about amino acids 318 to 325 of SEQ ID NO:32; one amidation site (Prosite PS00009) located at about amino acids 377 to 380 of SEQ ID NO:32; and six N-myristoylation sites (Prosite PS00008) located at about amino acids 103 to 108, 281 to 286, 327 to 332, 337 to 342, 437 to 442, and 449 to 454 of SEQ ID NO:32.

The 25501 protein contains a significant number of structural characteristics in common with members of the transferase family, in particular, of methyltransferases. In general, transferases catalyze the transfer of one molecular group from a donor molecule to an acceptor molecule. Examples of such molecular groups include phosphate, amino, methyl, acetyl, acyl, phosphatidyl, phosphoribosyl, among other groups. The methyltransferase family is a large superfamily of enzymes that regulate biological processes by catalyzing the transfer of methyl groups to a wide variety of endogenous and exogenous compounds, including DNA, RNA, proteins, hormones, neurotransmitters, drugs, and xenobiotics (Weinshilboum et al. (1999) *Annu. Rev. Pharmacol. Toxicol.* 39:19-52).

Methylation of DNA can play an important role in the control of gene expression in mammalian cells. DNA methyltransferases are involved in DNA methylation and catalyze the transfer of a methyl group from S-adenosylmethionine to cytosine residues to form 5-methylcytosine, a modified base that is found mostly at CpG sites in the genome. The presence of methylated CpG islands in the promoter region of genes can suppress their expression. This process may be due to the presence of 5-methylcytosine, which apparently interferes with the binding of transcription factors or other DNA-binding proteins to block transcription. In different types of tumors, aberrant or accidental methylation of CpG islands in the promoter region has been observed for many cancer-related genes, resulting in the silencing of their expression. Such genes include tumor suppressor genes, genes that suppress metastasis and angiogenesis, and genes that repair DNA (Momparler and Bovenzi (2000) *J. Cell Physiol.* 183:145-54).

Methylation of proteins is a post-translational modification which can regulate the activity and subcellular localization of numerous proteins. Methylation of proteins can play an important role in protein repair and reversal of protein aging. Proteins undergo a variety of spontaneous degradation processes, including oxidation, glycation, deamidation, isomerization, and racemization. These non-enzymatic modifications can produce functionally damaged species that reflect the action of aging at the molecular level (Stadtman (1992) *Science* 257:1220-1224; Martin et al. (1996) *Nat. Genet.* 13:25-34). Methylation of these damaged proteins e.g., by protein L-isoaspartyl methyltransferase (Shimizu et al. (2000) *Arch. Biochem. Biophys.* 381:225-34) can play a part in the repair pathway. Protein methylation is also known to be important in cellular stress responses (Desrosiers and Tanguay (1988) *J. Biol. Chem.* 263:4686-4692). Moreover, protein methyltransferases have recently been demonstrated to be important in cellular signaling events, for example, in receptor-mediated and/or differentiation-dependent signaling (Lin et al. (1996) *J. Biol. Chem.* 271:15034-15044; Abramovich et al. (1997) *EMBO J.* 16:260-266).

Methylation is a process important for the catabolism of small molecules, such as thiol compounds and neurotransmitters. A deficiency in thiol compound detoxification by methylation is being investigated for its role in rheumatoid arthritis (Waring and Emery (1993) *Baillieres Clin. Rheumatol.* 6:337-50). Inhibition of dopamine methylation and inactivation by catechol-O-methyl transferase is a goal for therapy of Parkinson's disease (Goldstein and Lieberman (1992) *Neurology* 42(suppl):8-12).

As used herein, the term "transferase" includes a protein or polypeptide which is capable of catalyzing the transfer of a molecular group from a donor molecule to an acceptor molecule. In order to catalyze molecular group transfer, the transferases must recognize or bind the group's donor then catalyze the transfer of the group to an acceptor molecule. In the process, the transferase itself can become an intermediate acceptor molecule, e.g., the alkylation of an active site cysteine in O(6)-alkylguanine-DNA alkyltransferase (Daniels and Tainer (2000) *Mutat. Res.* 460:151-163). Members of a transferase family of proteins typically are cytoplasmic or nuclear proteins. Transferases, e.g. methyltransferases typically include conserved motifs, including at least one Prosite methyltransferase signature sequence, e.g. PS01261, PS00092, or PS01184. The 25501 molecules of the invention include regions homologous to these motifs.

A 25501 polypeptide can include a "transfer domain" or a region homologous with a "transfer domain".

As used herein, the term "transfer domain" includes an amino acid sequence of about 50 to 250 amino acid residues in length and includes one, two, preferably three sequences homologous to the Prosite methylase or methyltransferase signature sequences PS01261, PS00092, and PS01184. Preferably, a transfer domain includes at least about 100 to 200 amino acids, more preferably about 120 to 150 amino acid residues, or about 130 to 140 amino acids and includes one, two, preferably three sequences homologous to Prosite methylase or methyltransferase signature sequences PS01261, PS00092, and PS01184. Preferably the Prosite sequences are arranged in the following order, first the PS01261, second the PS00092, third the PS01184 and are spaced about sixty amino acids or less from each other. Preferably a transfer domain catalyzes the transfer of a group, e.g. a methyl group from a donor to an acceptor molecule. The transfer domain of 25501 can be found at about amino acid residues 280 to 411 of SEQ ID NO:32.

A sequence similar to the Prosite sequence PS01261, the putative RNA methylase family UPF0020 signature, D-P-[LIVMF]-C-G-[ST]-G-x(3)-[LI]-E (SEQ ID NO:36) can be found in human 25501 at about amino acid residues 304 to 315 of SEQ ID NO:32, except an L replaces the [ST]. A sequence similar to the Prosite sequence PS00092, the N-6 adenine-specific DNA methylase signature, [LIVMAC]-[LIVFYWA]-x-[DN]-P—P—[FYW] (SEQ ID NO:37) can be found in human 25501 at about amino acid residues 371 to 377 of SEQ ID NO:32, except an L replaces the first P. A sequence similar to the Prosite sequence PS01184, the ubiE/COQ5 methyltransferase family signature 2, R—V-[LIVM]—K—[PV]-[GM]-G-x-[LIVMF]-x(2)-[LIVM]-E-x-S (SEQ ID NO:38) can be found in human 25501 at about amino acid residues 396 to 409 of SEQ ID NO:32, except an H replaces the K and the last three residues are L-S-E instead of E-x-S. In the above conserved signature sequences, and other motifs or signature sequences described herein, the standard IUPAC one-letter code for the amino acids is used. Each element in the pattern is separated by a dash (-); square brackets ([ ]) indicate the particular residues that are accepted at that position; x indicates that any residue is accepted at that position; and numbers in parentheses (( )) indicate the number of residues represented by the accompanying amino acid.

The transfer domain of the human 25501 protein is homologous, e.g., at least about 26%, 27%, 28%, 29%, 30%, 31%, 32%, 33%, 34%, 35%, 36%, 37%, 38%, 39%, 40%, or 41% identical to the ProDom family PD034341 ("VNG2242C Y71F9AL.1 MTH724 PH0338 AF1257 MJ0710 APE1835") domain (ProDomain Release 2001.1). The ProDom PD034341 domain and can include one, two, preferably three Prosite methylase or methyltransferase signature sequences or sequences homologous to these sequences spaced sixty amino acids or less apart. A GAP alignment of the transfer domain (amino acids 280 to 411 of SEQ ID NO:32) of human 25501 with amino acid residues 1 to 133 of the 172 amino acid PD034341 domain consensus sequence (SEQ ID NO:34), derived from a BLAST search model results in 32% identity (as calculated from the blosum62 matrix).

In a preferred embodiment, a 25501 polypeptide or protein has a "transfer domain" or a region which includes at least about 100 to 200 more preferably about 120 to 150 or 130 to 140 amino acid residues and has at least about 60%, 70% 80% 90% 95%, 99%, or 100% homology with a "transfer domain," e.g., the transfer domain of human 25501 (e.g., residues 280 to 411 of SEQ ID NO:32).

Regions similar to the transfer domain are found in other proteins. For example, a transfer domain can be found in MGC:2454 (SEQ ID NO:35, accession number 13278783 in GenPept; corresponding to number BC004163 in GenBank). MGC:2454 is homologous to the 25501 protein in SEQ ID NO:32. An alignment of the 25501 protein with MGC:2454 results in about 94% overall sequence identity between the two sequences. Sequence identity of 100% can be found in regions beginning about amino acid 1 to 473 of MGC:2454

(SEQ ID NO:35) with amino acids about 31 to 503 of 25501, SEQ ID NO:32 (as calculated in matblas from the blosum62.iij matrix).

To make the determination that the "transfer" domain in a 25501 protein sequence or a polypeptide or protein of interest has a particular profile, the amino acid sequence of the protein can be searched against a database of domains, e.g., the ProDom database (Corpet et al. (1999), *Nucl. Acids Res.* 27:263-267). The ProDom protein domain database consists of an automatic compilation of homologous domains. Current versions of ProDom are built using recursive PSI-BLAST searches (Altschul et al. (1997) *Nucleic Acids Res.* 25:3389-3402; Gouzy et al. (1999) *Computers and Chemistry* 23:333-340) of the SWISS-PROT 38 and TREMBL protein databases. The database automatically generates a consensus sequence for each domain. A BLAST search was performed against the database resulting in the PD034341 profile of the "transfer" domain in the amino acid sequence of human 25501 at about residues 280 to 411 of SEQ ID NO:32.

A 25501 molecule can further include a recognition/binding domain or regions homologous with a "recognition/binding domain." As used herein, the "recognition/binding domain" includes an amino acid sequence of about 100 to 350 amino acid residues in length and whose secondary structure is characterized by a high alpha helical content. Table 14, below, illustrates the prediction of the likelihood of amino acid residues from this region of 25501 to belong to an element of secondary structure by two prediction methods.

TABLE 14

Secondary Structure Prediction of Amino Acid Residues 117 to 198 of SEQ ID NO:32

| A | B | C | D |
|---|---|---|---|
| 30 | V | H | H |
| 31 | M | H | H |
| 32 | R | H | H |
| 33 | E | H | H |
| 34 | V | H | H |
| 35 | R | H | H |
| 36 | A | H | H |
| 37 | R | H | H |
| 38 | L | H | H |
| 39 | A | H | H |
| 40 | A | H | H |
| 41 | T | H | H |
| 42 | Q | H | H |
| 43 | V | H | H |
| 44 | E | H | H |
| 45 | Y | • | H |
| 46 | I | • | T |
| 47 | S | t | T |
| 48 | G | t | T |
| 49 | K | • | T |

TABLE 14-continued

Secondary Structure Prediction of Amino Acid Residues 117 to 198 of SEQ ID NO:32

| A | B | C | D |
|---|---|---|---|
| 50 | V | • | B |
| 51 | F | • | B |
| 52 | F | • | B |
| 53 | T | • | B |
| 54 | T | t | B |
| 55 | C | t | H |
| 56 | S | T | H |
| 57 | D | T | H |
| 58 | L | • | H |
| 59 | N | • | H |
| 60 | M | H | H |
| 61 | L | H | H |
| 62 | K | H | H |
| 63 | K | H | H |
| 64 | L | H | H |
| 65 | K | H | H |
| 66 | S | H | H |
| 67 | A | H | H |
| 68 | E | H | H |
| 69 | R | B | H |
| 70 | L | B | H |
| 71 | F | B | H |
| 72 | L | B | H |
| 73 | L | B | H |
| 74 | I | B | H |
| 75 | K | • | H |
| 76 | K | • | H |
| 77 | Q | B | B |
| 78 | F | B | B |
| 79 | P | B | B |
| 80 | L | B | B |
| 81 | I | B | B |
| 82 | I | B | B |
| 83 | S | • | B |
| 84 | S | • | • |
| 85 | V | • | • |
| 86 | S | • | • |

TABLE 14-continued

Secondary Structure Prediction of Amino Acid Residues 117 to 198 of SEQ ID NO:32

| A | B | C | D |
|---|---|---|---|
| 87 | K | h | • |
| 88 | G | h | • |
| 89 | K | h | • |
| 90 | I | h | • |
| 91 | F | h | B |
| 92 | N | h | B |
| 93 | E | h | B |
| 94 | M | b | B |
| 95 | Q | b | • |
| 96 | R | b | • |
| 97 | L | b | • |
| 98 | I | b | • |
| 99 | N | b | • |
| 100 | E | t | • |
| 101 | D | t | • |
| 102 | P | T | T |
| 103 | G | T | T |
| 104 | S | T | T |
| 105 | W | B | • |
| 106 | L | B | • |
| 107 | N | B | • |
| 108 | A | B | • |
| 109 | I | B | • |
| 110 | S | B | • |
| 111 | I | B | • |
| 112 | W | B | H |
| 113 | K | B | H |
| 114 | N | B | H |
| 115 | L | B | H |
| 116 | L | B | H |
| 117 | E | H | H |
| 118 | L | H | H |
| 119 | D | H | H |
| 120 | A | H | H |
| 121 | K | H | H |
| 122 | K | H | H |
| 123 | E | H | H |
| 124 | K | H | H |
| 125 | L | H | H |
| 126 | S | H | H |
| 127 | Q | H | H |
| 128 | R | H | H |
| 129 | D | t | H |
| 130 | D | T | H |
| 131 | N | T | H |
| 132 | Q | H | H |
| 133 | L | H | • |
| 134 | K | H | • |
| 135 | R | H | • |
| 136 | K | H | • |
| 137 | V | H | • |
| 138 | G | H | H |
| 139 | E | H | H |
| 140 | N | H | H |
| 141 | E | H | H |
| 142 | I | H | H |
| 143 | I | H | H |
| 144 | A | H | H |
| 145 | K | H | H |
| 146 | K | H | H |
| 147 | L | H | H |
| 148 | K | H | H |
| 149 | I | H | H |
| 150 | E | H | H |
| 151 | Q | H | H |
| 152 | M | H | H |
| 153 | Q | H | H |
| 154 | K | H | H |
| 155 | I | H | H |
| 156 | E | H | H |
| 157 | E | H | H |
| 158 | N | • | H |
| 159 | R | T | H |
| 160 | D | T | H |

TABLE 14-continued

Secondary Structure Prediction of Amino Acid Residues 117 to 198 of SEQ ID NO:32

| A | B | C | D |
|---|---|---|---|
| 161 | C | t | H |
| 162 | Q | H | H |
| 163 | L | H | H |
| 164 | E | H | H |
| 165 | K | H | H |
| 166 | Q | H | H |
| 167 | I | H | H |
| 168 | K | H | H |
| 169 | E | H | H |
| 170 | E | H | H |
| 171 | T | H | H |
| 172 | L | H | H |
| 173 | E | H | H |
| 174 | Q | H | H |
| 175 | R | H | H |
| 176 | D | H | H |
| 177 | F | H | H |
| 178 | T | H | H |
| 179 | T | H | • |
| 180 | K | H | • |
| 181 | S | H | • |
| 182 | E | H | • |
| 183 | K | H | H |
| 184 | F | H | H |
| 185 | Q | H | H |
| 186 | E | H | H |
| 187 | E | H | H |
| 188 | E | H | H |
| 189 | F | H | H |
| 190 | Q | t | H |
| 191 | N | t | H |
| 192 | D | H | H |
| 193 | I | H | H |
| 194 | E | H | H |
| 195 | K | H | H |
| 196 | A | H | H |
| 197 | I | H | |
| 198 | D | H | H |
| 199 | T | t | • |
| 200 | H | t | • |
| 201 | N | t | • |
| 202 | Q | T | T |
| 203 | N | T | T |
| 204 | D | t | T |
| 205 | L | B | T |
| 206 | T | B | T |
| 207 | F | B | T |
| 208 | R | B | T |
| 209 | V | B | T |
| 210 | S | • | T |
| 211 | C | t | T |
| 212 | R | T | T |
| 213 | C | T | T |
| 214 | S | T | T |
| 215 | G | T | T |
| 216 | T | • | T |
| 217 | I | • | • |
| 218 | G | • | • |
| 219 | K | H | • |
| 220 | A | H | • |
| 221 | F | H | H |
| 222 | T | H | H |
| 223 | A | H | H |
| 224 | Q | H | H |
| 225 | E | H | H |
| 226 | V | H | H |
| 227 | G | • | H |
| 228 | K | • | H |
| 229 | V | • | H |
| 230 | I | • | H |
| 231 | G | • | H |
| 232 | I | h | H |
| 233 | A | h | H |
| 234 | I | h | H |

TABLE 14-continued

Secondary Structure Prediction of Amino Acid Residues 117 to 198 of SEQ ID NO:32

| A | B | C | D |
|---|---|---|---|
| 235 | M | h | H |
| 236 | K | h | H |
| 237 | H | h | H |
| 238 | F | h | T |
| 239 | G | h | T |
| 240 | W | h | T |
| 241 | K | h | • |
| 242 | A | h | • |
| 243 | D | h | • |
| 244 | L | h | • |
| 245 | R | t | • |
| 246 | N | t | • |
| 247 | P | t | • |
| 248 | Q | t | • |
| 249 | L | • | B |
| 250 | E | • | B |

Legend:
Column A = the AA position in 25501,
column B = the AA at that position,
column C = the Chou-Fasman secondary structure prediction for that AA (Chou and Fasman (1974) Biochemistry 13:222-244), and
column D = the Garnier-Osguthorpe-Robson secondary structure prediction for that AA (Garnier et al. (1978) J. Mol. Biol. 120:97-120).
Capital letters = strong predictions, lower case letters = weaker and
"•" = random coil or no prediction of one of the following motifs, "H" or "h" for alpha helix, "B" or "b" for beta sheet strand, and "T" or "t" for a turn.

As shown in Table 14, the prediction methods agree that the majority of residues in this region, in particular, residues 117 to 198 of SEQ ID NO:32, can form alpha helices. Proteins can use alpha helices to recognize and bind nucleic acid molecules. For example, the helix-turn-helix DNA binding domain is involved in a variety of protein-DNA interactions (Wintjens and Rooman (1996) *J. Mol. Biol.* 262:294-313), with variations in additional helices and helix arrangements distinguishing protein families from one another. Proteins can use alpha helices to determine the specificity of ligand interactions. For example, amino acid residues on helices in the ligand binding pocket of steroid receptors allow the discrimination between different steroid hormones (Ekena et al. (1998) *J. Biol. Chem.* 273:693-699).

In a preferred embodiment, a 25501 polypeptide or protein has a "recognition/binding domain" or a region which includes at least about 150 to 300 more preferably about 180 to 260 or 210 to 230 amino acid residues and has at least about 60%, 70% 80% 90% 95%, 99%, or 100% homology with a "recognition/binding domain," e.g., the recognition/binding domain of human 25501 (e.g., residues 30 to 250 of SEQ ID NO:32).

To identify the presence of a "recognition/binding" domain in a 25501 protein sequence, and make the determination that a polypeptide or protein of interest has a particular profile, the amino acid sequence of the protein can be analyzed by a secondary structure prediction method that predicts the secondary structure of proteins based on the characteristics of each amino acid (Chou and Fasman (1974) *Biochemistry* 13:222-244 and Garnier et al. (1978) *J. Mol. Biol.* 120:97-120).

A 25501 family member can include at least one transfer domain. A 25501 family member also can include at least one recognition/binding domain. Furthermore, a 25501 family member can include at least one, two, three, four, five preferably six protein kinase C phosphorylation sites (Prosite PS00005); at least one, two, three, four, five, six, seven, eight, nine and preferably ten casein kinase II phosphorylation sites (Prosite PS00006); at least one tyrosine kinase phosphorylation site (Prosite PS00007); at least one cAMP/cGMP protein kinase phosphorylation sites (Prosite PS00004); at least one amidation site (Prosite PS00009); and at least one, two, three, four, five preferably six N-myristoylation sites (Prosite PS00008).

Polypeptides of the invention include fragments which include: all or part of a hydrophobic sequence, e.g., the sequence from about amino acid 258 to 267, from about 353 to 363, and from about 100 to 108 of SEQ ID NO:32; all or part of a hydrophilic sequence, e.g., the sequence from about amino acid 121 to 132, from about 150 to 160, and from about 410 to 423 of SEQ ID NO:32; a sequence which includes a Cys, or a glycosylation site.

As the 25501 polypeptides of the invention can modulate 25501-mediated activities, they can be useful for developing novel diagnostic and therapeutic agents for transferase-associated or other 25501-associated disorders, as described below.

As used herein, a "transferase-associated activity" includes an activity which involves a transfer function, e.g. the transfer of a group, e.g. a methyl group from a donor molecule to an acceptor molecule. This function is implicated in a wide range of cell activities, including, but not limited to cell growth and cell processes, e.g., the regulation of cell proliferation, differentiation, migration, protein transport, gene expression, and/or intra- or intercellular signaling, and apoptosis. Members of the family can play a role in cancer, developmental syndromes, such as Fragile X and Rett (El-Osta and Wolf (2000) *Gene Expr.* 9:63-75), neurodegenerative disorders such as Alzheimer's disease (Shimizu et al. (2000) *Arch. Biochem. Biophys.* 381:225-34), and Parkinson's disease (Goldstein and Lieberman (1992) *Neurology* 42 (suppl4):8-12), and inflammatory disorders such as rheumatoid arthritis (Waring and Emery (1992) *Baillieres Clin. Rheumatol.* 6:337-50).

As used herein, a "25501 activity", "biological activity of 25501" or "functional activity of 25501", refers to an activity exerted by a 25501 protein, polypeptide or nucleic acid molecule on e.g., a 25501-responsive cell or on a 25501 substrate, e.g., a protein substrate, as determined in vivo or in vitro. In one embodiment, a 25501 activity is a direct activity, such as an association with a 25501 target molecule. A "target molecule" or "binding partner" is a molecule with which a 25501 protein binds or interacts in nature. In an exemplary embodiment, 25501 is a transferase, e.g., a methyltransferase, and thus has the ability to bind to, or interact with, a substrate or target molecule, e.g., a nucleic acid molecule (e.g. DNA or RNA), a small organic molecule (e.g., a hormone, a neurotransmitter or a coenzyme), or a protein; and/or the ability to transfer a group, e.g. a methyl group from a donor to an acceptor molecule, e.g. the substrate or target molecule.

A 25501 activity can also be an indirect activity, e.g., a cellular signaling activity mediated by interaction of the 25501 protein with a 25501 receptor. Based on the above-described sequence structures and similarities to molecules of known function, the 25501 molecules of the present invention can have similar biological activities as transferase family members. For example, the 25501 proteins of the present invention can have one or more of the following activities: (1) the ability to interact with a 25501 substrate or target molecule (e.g., a non-25501 protein); (2) the ability to convert a 25501 substrate or target molecule to a product (e.g., transfer of a methyl group to or from the substrate or target molecule); (3) the ability to interact with and/or methyl transfer to a second non-25501 target molecule e.g., a nucleic acid molecule (e.g., DNA or RNA), a small organic molecule (e.g., a hormone, neurotransmitter or a coenzyme) or a protein; (4) the ability to regulate substrate or target molecule activity; (5) the ability to modulate intra- or intercellular signaling and/or gene transcription (e.g., either directly or indirectly); (6) the ability to modulate cellular targeting and/or transport of proteins; (7) the ability to modulate cellular proliferation, growth, or differentiation; (8) the ability to modulate cell migration and/or (9) the ability to modulate apoptosis.

The 25501 molecules of the invention can modulate the activities of cells in tissues where they are expressed. For example, 25501 mRNA is expressed in brain, in particular the astrocytes, which provide physical and biochemical support for neurons and interact with capillary endothelial cells to form the blood-brain barrier. 25501 mRNA also can be found in the ovary and prostate epithelium. 25501 mRNA also is expressed in tissues undergoing large amounts of growth, differentiation and angiogenesis such as fetal and neonatal kidney, fetal heart and fetal adrenal gland. 25501 mRNA also is expressed in cancerous tissue, especially malignant tumors, such as Wilm's tumor, lung tumor, colon tumor, metastases of colon tumor in the liver, metastases of prostate tumor in the liver, metastases of breast tumors in the lung and brain. Accordingly, the 25501 molecules of the invention can act as novel diagnostic targets or therapeutic agents for neurological disorders, ovarian disorders, prostate disorders, or proliferative and/or differentiative disorders or other transferase disorders.

Gene Expression Analysis of 25501 by TaqMan® Analysis

Human 25501 expression was measured by TaqMan® quantitative PCR (Perkin Elmer Applied Biosystems) in cDNA prepared from a variety of normal and diseased (e.g., cancerous) human tissues or cell lines.

The results indicate significant 25501 expression in brain, e.g. glial cells (e.g. a high level in astrocytes); a medium level in the ovary; in the prostate e.g. a medium level in prostate epithelium; in tissues undergoing large amounts of growth, differentiation and angiogenesis, e.g. medium levels in the fetus and neonate (e.g. fetal and neonatal kidney fetal heart and fetal adrenal gland); and in cancerous tissue, e.g. tumors (e.g. medium levels in lung tumor, colon tumor and metastases of colon tumor in the liver, and high levels in Wilm's tumor and metastases of prostate tumor in the liver).

Transcriptional Profiling

The expression profiles of samples of metastatic brain and lung tumors originating from human breast adenocarcinoma tumors were compared with the profiles samples from primary human breast adenocarcinoma tumors. Total RNA was isolated from the tissue samples. Reverse transcriptase was used to generate $^{33}$P-dCTP-labeled cDNAs from the RNA. These experimental tissue cDNAs were hybridized to an array of molecules with known sequences. The nylon array contained 9600 elements, each with a PCR product from cDNA clones of the known genes. The hybridization levels from each tissue sample are measured and compared. Comparisons resulting in at least a 1.5-fold difference were judged as significant. The 25501 transcript was identified as being upregulated in the lung and brain metastatic tumors originating from human breast adenocarcinoma tumors.

Human 17903

The present invention is based, at least in part, on the discovery of a novel aminopeptidase referred to herein as "17903". The present invention provides the human 17903 sequence (SEQ ID NO:39), which is approximately 3034 nucleotides long including untranslated regions, contains a predicted methionine-initiated coding sequence of about 2178 nucleotides (nucleotides 18 to 2195 of SEQ ID NO:39; SEQ ID NO:41). The coding sequence encodes a 725 amino acid protein (SEQ ID NO:40).

The 17903 protein includes a Pfam Peptidase family M1 consensus domain, as well as Prodom consensus domains for aminopeptidases. For general information regarding PFAM identifiers, PS prefix and PF prefix domain identification numbers, refer to Sonnhammer et al. (1997) *Protein* 28:405-420.

The 17903 protein contains a significant number of structural characteristics in common with members of the aminopeptidase M1 family of metallopeptidases. Aminopeptidases (APs) are a group of widely distributed exopeptidases that catalyze the hydrolysis of amino acid residues from the amino-terminus of polypeptides and proteins. The enzymes are found in plant and animal tissues, in eukaryotes and prokaryotes, and in secreted and soluble forms. Biological functions of aminopeptidases include protein maturation, terminal degradation of proteins, hormone level regulation, and cell-cycle control.

Aminopeptidases are implicated in a host of conditions and disorders including aging, cancers, inflammatory diseases, cataracts, cystic fibrosis and leukemias. In eukaryotes, APs are associated with removal of the initiator methionine. In prokaryotes the methionine is removed by methionine aminopeptidase subsequent to removal of the N-formyl group from the initiator N-formyl methionine, facilitating subsequent modifications such as N-acetylation and N-myristoylation. In *E. coli* AP-A (pepA), the xerB gene product is required for stabilization of unstable plasmid multimers.

APs are also involved in the metabolism of secreted regulatory molecules, such as hormones and neurotransmitters, and modulation of cell-cell interactions. In mammalian cells and tissues, the enzymes are apparently required for terminal stages of protein degradation, and EGF-induced cell-cycle control; and may have a role in protein turnover and selective elimination of obsolete or defective proteins. Furthermore, the enzymes are implicated in the supply of amino acids and energy during starvation and/or differentiation, and degradation of transported exogenous peptides to amino acids for nutrition. APs may also have a role in inflammation. Industrial uses of the enzymes include modification of amino termini in recombinantly expressed proteins. See A. Taylor (1993) *TIBS* 18: 1993:167-172.

Aminopeptidases have been identified in a wide variety of tissues and organisms, including zinc aminopeptidase and aminopeptidase M from rat kidney membrane; human aminopeptidase N from intestine; arginine aminopeptidase from liver; aminopeptidase N$^b$ from muscle; leukotriene-A4 hydrolase; leucine aminopeptidase (LAP) from bovine and hog lens and kidney; aminopeptidase A (xerB gene product) from *E. coli*; yscl APE1/LAP4 and aminopeptidase A (pep4 gene product) from *S. cerevisiae*; LAP from *aeromonas*; dipeptidase from mouse ascites; methionine aminopeptidase from *salmonella, E. coli, S. cerevisiae* and hog liver; and D-amino acid aminopeptidase from *ochrobactrum anthropi* SCRC C1-38.

As used herein, the term "aminopeptidase" refers to a protein or polypeptide that is capable of catalyzing the cleavage of a polypeptide bond at the amino terminus of a polypeptide molecule through hydrolysis (i.e., possessing amino-terminal polypeptide hydrolytic activity or exopeptidase activity). As referred to herein, aminopeptidases preferably include a catalytic domain of about 150-350 amino acid residues in length, preferably 200-300 amino acid residues in length, or more preferably 220-280 amino acids in length. Based on the sequence similarities described above, the 17903 molecules of the present invention are predicted to have similar biological activities as aminopeptidase family members.

As the biological functions of aminopeptidases include protein maturation and protein degradation, they typically play a role in diverse cellular processes. In particular, aminopeptidases have been shown to have a role in tumor growth, metastasis, and angiogenesis; in inflammatory disorders including, but not limited to osteoarthritis and rheumatoid arthritis, multiple sclerosis, Crohn disease, psoriasis, periodontal disease, and asthma; in cataracts; in cystic fibrosis; in leukemias; and in aging.

A 17903 polypeptide can include an "aminopeptidase zinc-binding motif" or regions homologous with the "Peptidase M1 family of aminopeptidases".

As used herein, the term "Peptidase M1 family of aminopeptidases domain" includes an amino acid sequence having a bit score for the alignment of the sequence to the Peptidase M1 family domain (HMM) of at least 8. Preferably, a peptidase M1 family of aminopeptidases domain includes at least about 150-350 amino acids, more preferably 200-300 amino acids, or about 220-280 amino acids and has a bit score for the alignment of the sequence to the aminopeptidase domain (HMM) of at least 16 or greater. The Peptidase M1 family (HMM) has been assigned the PFAM Accession PF01433. An alignment of the Peptidase M1 family of aminopeptidases domain of human 17903 (amino acids 195 to 445 of SEQ ID NO:40) with the consensus amino acid sequences derived from a hidden Markov model yields a bit score for the alignment of the sequence to the amino-peptidase domain (HMM) of 172 (E=4.3e-59). The identified consensus amino acid sequence for the Peptidase M1 family of aminopeptidases is depicted in SEQ ID NO:42.

In a preferred embodiment 17903 polypeptide or protein has a "peptidase M1 family of aminopeptidases domain" or a region which includes at least about 60%, 70%, 80%, 90%, 95%, 99%, or 100% homology with the Peptidase M1 family of aminopeptidases (e.g., amino acid residues 195 to 445 of SEQ ID NO:40).

To identify the presence of a Peptidase M1 aminopeptidase region of homology in a 17903 protein sequence, and make the determination that a polypeptide or protein of interest has a particular profile, the amino acid sequence of the protein can be searched against a database of HMMs (e.g., the Pfam database, release 2.1) using the default parameters. For example, the hmmsf program, which is available as part of the HMMER package of search programs, is a family specific default program for MILPAT0063 and a score of 15 is the default threshold score for determining a hit. Alternatively, the threshold score for determining a hit can be lowered (e.g., to 8 bits). A description of the Pfam database can be found in Sonhammer et al. (1997) *Proteins* 28(3):405-420 and a detailed description of HMMs can be found, for example, in Gribskov et al. (1990) *Meth. Enzymol.* 183:146-159; Gribskov et al. (1987) *Proc. Natl. Acad. Sci. USA* 84:4355-4358; Krogh et al. (1994) *J. Mol. Biol.* 235:1501-1531; and Stultz et al. (1993) *Protein Sci.* 2:305-314, the contents of which are incorporated herein by reference.

As the 17903 polypeptides of the invention may modulate 17903-mediated activities, they may be useful for developing novel diagnostic and therapeutic agents for 17903-mediated or related disorders, as described below.

As used herein, a "17903 activity", "biological activity of 17903" or "functional activity of 17903", refers to an activity exerted by a 17903 protein, polypeptide or nucleic acid molecule on e.g., a 17903-responsive cell or on a 17903 polypeptide substrate, as determined in vivo or in vitro. In one embodiment, a 17903 activity is a direct activity, such as an association with a 17903 target molecule. A "target molecule" or "binding partner" or "ligand" or "substrate" is a molecule with which a 17903 protein binds or interacts in nature, e.g., a polypeptide that a 17903 protein cleaves. A 17903 activity can also be an indirect activity, e.g., a cellular signaling activity mediated by interaction of the 17903 protein with a 17903 ligand. For example, the 17903 proteins of the present invention can have one or more of the following activities: 1) cleavage of a protein precursor to maturation; 2) catalysis of protein degradation; 3) regulation of hormone levels; 4) modulation of tumor cell growth and invasion; 5) modulation of angiogenesis; and 6) regulation of cell proliferation.

Polypeptides of the invention include fragments which include: all or a part of a hydrophobic sequence, e.g. residues from about 317 to 352 of SEQ ID NO:40; or all or part of a hydrophilic fragment, e.g. residues from about 676 to 704 of SEQ ID NO:40. Other fragments include a cysteine residue or an N-glycosylation site.

The expression profile for 17903 is depicted in Tables 15-29 below. As depicted in tables 15-29, 17903 is up-regulated in proliferating endothelial cells compared to arrested endothelial cells in 5 out of 5 independent experiments. 17903 is further up-regulated in some lung, breast, ovary, and brain tumors as compared to normal tissues. 17903 is expressed in hemangiomas and the expression levels in hemangiomas are 30-50 fold higher than the expression level in normal skin. In addition, 17903 is expressed in other angiogenic tissues such as Wilms tumors, uterine adenocarcinoma, neuroblastoma, fetal adrenal gland, and fetal kidney. Mouse 17903 is up-regulated in VEGF plugs as compared to parental plugs in the xenograft model. In the RIP-Taq mouse model, the expression of 17903 is up-regulated in tumor islets and the expression levels of 17903 correlate to the expression levels of VEGF at various stages of tumor development.

Expression of 17903 was measured in various clinical samples by in situ hybridization. 17903 was weakly expressed in one of two breast tumor epithelial cell samples, but not in either of two normal breast samples. Three of four primary colon tumor and metastases were positive for 17903 expression, while 17903 was not detected in the normal colon control. 17903 was expressed in five of seven samples of malignant epithelium of several histologically different lung tumor subtypes, but was not detected in the normal lung control sample. 17903 was expressed in both malignant ovary epithelium and normal stroma of the ovary.

The methods of the present invention are most relevant to those normal and diseased tissues where 17903 is expressed, including the tissues described above as well as those shown in Tables 15-29 below. The expression pattern of 17903 in human samples and mouse models suggest that 17903 plays a positive role in cellular proliferation (including endothelial proliferation), tumor angiogenesis, and/or tumorogenesis. Accordingly, inhibition of 17903 function may inhibit tumor angiogenesis and tumor growth.

Identification and Characterization of Human 17903 cDNAs

The human 17903 sequence (SEQ ID NO:39), which is approximately 3034 nucleotides long including untranslated regions, contains a predicted methionine-initiated coding sequence of about 2175 nucleotides (nucleotides 18-2192 of SEQ ID NO:39; SEQ ID NO:41). The coding sequence encodes a 725 amino acid protein (SEQ ID NO:40).

Tissue Distribution of 17903 mRNA

The expression of 17903 was monitored in various tissues and cell types by quantitative PCR (TaqMan® brand quantitative PCR kit, Applied Biosystems) according to the kit manufacture's instructions. The results are shown below in Tables 15-29.

TABLE 15

EXPRESSION OF 17903 IN HUMAN ANGIOGENESIS-RELATED TISSUES

| Tissue Type | Beta 2 | Average 17903.1 | Average Beta 2 | Δ Ct | Relative Expression |
|---|---|---|---|---|---|
| Hemangioma | 31.84 | 19.89 | 11.95 | | 0.25 |
| Hemangioma | 26.23 | 19.04 | 7.19 | | 6.87 |
| Hemangioma | 26.06 | 19.46 | 6.60 | | 10.34 |
| Normal Kidney | 28.12 | 21.52 | 6.60 | | 10.34 |
| Renal Cell Carcinoma | 30.00 | 20.56 | 9.44 | | 1.44 |
| Wilms Tumor | 25.85 | 19.26 | 6.59 | | 10.38 |
| Wilms Tumor | 29.70 | 22.66 | 7.04 | | 7.63 |
| Skin | 34.65 | 22.36 | 12.29 | | 0.20 |
| Uterine Adenocarcinoma | 27.03 | 19.34 | 7.69 | | 4.86 |
| Neuroblastoma | 27.29 | 20.11 | 7.18 | | 6.90 |
| Fetal Adrenal | 26.84 | 18.41 | 8.43 | | 2.90 |
| Fetal Kidney | 27.67 | 20.97 | 6.70 | | 9.62 |
| Fetal Heart | 24.90 | 18.62 | 6.28 | | 12.87 |
| Normal Heart | 25.72 | 19.66 | 6.06 | | 14.99 |
| Cartilage | 34.89 | 24.99 | 9.91 | | 1.04 |
| Spinal cord | 28.12 | 20.78 | 7.34 | | 6.17 |
| lymphangioma | 33.19 | 24.61 | 8.58 | | 2.62 |
| Endometrial polyps | 36.06 | 26.25 | 9.81 | | 1.11 |
| Synovium (RA) | 31.25 | 23.11 | 8.14 | | 3.56 |
| Hyperkeratotic skin | 30.30 | 23.43 | 6.87 | | 8.55 |

TABLE 16

EXPRESSION OF 17903 IN HUMAN CINICAL SAMPLES

| Tissue Type | Mean | β 2 Mean | δδCt | Expression |
|---|---|---|---|---|
| PIT 400 Normal Breast | 26.68 | 17.14 | 9.54 | 1.3387 |
| PIT 372 Normal Breast | 29.3 | 19 | 10.3 | 0.7932 |
| PIT 56 Normal Breast | 28.57 | 21.13 | 7.45 | 5.7389 |
| MDA 106 Breast Tumor | 27.55 | 19.31 | 8.24 | 3.2962 |
| MDA 234 Breast Tumor | 25.16 | 16.48 | 8.68 | 2.4466 |
| NDR 57 Breast Tumor | 27.16 | 17.85 | 9.31 | 1.5755 |
| MDA 304 Breast Tumor | 26.73 | 17.83 | 8.89 | 2.1006 |
| NDR 58 Breast Tumor | 23.63 | 16.23 | 7.41 | 5.9003 |
| NDR 132 Breast Tumor | 26.78 | 20.02 | 6.76 | 9.2265 |
| NDR 07 Breast Tumor | 27.77 | 18.02 | 9.75 | 1.1613 |
| NDR 12 Breast Tumor | 26.34 | 20.47 | 5.88 | 16.9802 |
| PIT 208 Normal Ovary | 27.2 | 17.52 | 9.68 | 1.2233 |
| CHT 620 Normal Ovary | 27.32 | 18.02 | 9.3 | 1.5809 |
| CHT 619 Normal Ovary | 27.14 | 18.45 | 8.69 | 2.4297 |
| CLN 03 Ovary Tumor | 28.11 | 18.25 | 9.87 | 1.0724 |
| CLN 05 Ovary Tumor | 26.31 | 17.47 | 8.84 | 2.1822 |
| CLN 17 Ovary Tumor | 25.59 | 18.63 | 6.96 | 8.0321 |
| CLN 07 Ovary Tumor | 27.99 | 17.67 | 10.32 | 0.7823 |

TABLE 16-continued

EXPRESSION OF 17903 IN HUMAN CINICAL SAMPLES

| Tissue Type | Mean | β 2 Mean | δδCt | Expression |
|---|---|---|---|---|
| CLN 08 Ovary Tumor | 27.59 | 17.21 | 10.38 | 0.7504 |
| MDA 216 Ovary Tumor | 28.65 | 19.07 | 9.58 | 1.3066 |
| CLN 012 Ovary Tumor | 26.43 | 19.65 | 6.79 | 9.068 |
| MDA 25 Ovary Tumor | 26.41 | 20.19 | 6.21 | 13.4617 |
| MDA 183 Normal Lung | 25.23 | 16.56 | 8.68 | 2.4466 |
| CLN 930 Normal Lung | 28.5 | 19.3 | 9.21 | 1.6944 |
| MDA 185 Normal Lung | 26.71 | 18.07 | 8.64 | 2.5067 |
| CHT 816 Normal Lung | 27.49 | 17.39 | 10.1 | 0.9112 |
| MPI 215 Lung Tumor--SmC | 24.8 | 17.68 | 7.11 | 7.239 |
| MDA 259 Lung Tumor-PDNSCCL | 25.04 | 18.2 | 6.84 | 8.6986 |
| CHT 832 Lung Tumor-PDNSCCL | 25.27 | 17.48 | 7.78 | 4.5497 |
| MDA 253 Lung Tumor-PDNSCCL | 25.34 | 17.02 | 8.31 | 3.14 |
| CHT 814 Lung Tumor-SCC | 23.27 | 15.99 | 7.28 | 6.4566 |
| CHT 793 Lung Tumor-ACA (?) | 25.35 | 17.2 | 8.15 | 3.5205 |
| MDA 262 Lung Tumor-SCC | 27.22 | 21.73 | 5.5 | 22.1738 |
| CHT 211 Lung Tumor-AC | 26.22 | 18.32 | 7.9 | 4.1866 |
| Normal Human Bronchial Epithelium | 24.2 | 18.84 | 5.37 | 24.2647 |

TABLE 17

17903 EXPRESSION IN HUMAN CLINICAL SAMPLES

| Tissue Type | Mean | β2 Mean | δδ Ct | Expression |
|---|---|---|---|---|
| CHT 523 Normal Colon | 25.38 | 18.17 | 7.21 | 6.78 |
| NDR 104 Normal Colon | 23.93 | 18.02 | 5.91 | 16.69 |
| CHT 416 Normal Colon | 26.73 | 19.02 | 7.71 | 4.78 |
| CHT 452 Normal Colon | 26.41 | 17.18 | 9.22 | 1.67 |
| NDR 210 Colon Tumor | 28.69 | 22.56 | 6.13 | 14.23 |
| CHT 398 Colon Tumor | 23.16 | 18.59 | 4.58 | 41.96 |
| CHT 382 Colon Tumor | 29.18 | 20.66 | 8.53 | 2.71 |
| CHT 944 Colon Tumor | 24.9 | 17.86 | 7.04 | 7.63 |
| CHT 528 Colon Tumor | 22.86 | 17.67 | 5.2 | 27.30 |
| CHT 368 Colon Tumor | 23.56 | 16.59 | 6.96 | 8.03 |
| CHT 372 Colon Tumor | 25.14 | 18.64 | 6.5 | 11.05 |
| CLN 609 Colon Tumor | 24.39 | 18.32 | 6.07 | 14.94 |
| CHT 01 Colon Cancer Liver Metastases | 23.82 | 17.49 | 6.33 | 12.43 |
| CHT 3 Colon Cancer Liver Metastases | 26.32 | 20 | 6.32 | 12.52 |
| CHT 340 Colon Cancer Liver Metastases | 25.29 | 19.77 | 5.53 | 21.72 |
| NDR 217 Colon Cancer Liver Metastases | 25.84 | 18.05 | 7.79 | 4.52 |
| Pit 260 Normal Liver | 25.15 | 16.5 | 8.65 | 2.49 |
| CHT 320 Normal Liver | 27.98 | 21.43 | 6.55 | 10.67 |
| A4 Arresting Human Microvascular Endothelial Cells HMVEC-Arr | 22.56 | 17.45 | 5.11 | 29.06 |
| C48 Proliferating Human Microvascualr Endothelial Cells | 24.07 | 19.65 | 4.43 | 46.39 |
| CHT 50 Placenta | 30.29 | 24.45 | 5.84 | 17.40 |
| ONC 102 Hemangioma | 25.95 | 18.4 | 7.55 | 5.32 |

TABLE 18

EXPRESSION OF MOUSE 17903 IN MOUSE TUMOR ANGIOGENIC TISSUES

| Tissue Type | Mean | β2 Mean | δδCt | Expression |
|---|---|---|---|---|
| RIP Angio | 25.49 | 17.53 | 7.96 | 4.0161 |
| RIP Tumor | 25.77 | 18.17 | 7.61 | 5.1365 |

TABLE 18-continued

EXPRESSION OF MOUSE 17903 IN MOUSE TUMOR ANGIOGENIC TISSUES

| Tissue Type | Mean | β2 Mean | δδCt | Expression |
|---|---|---|---|---|
| Xeno Parent 1 | 26.07 | 17.22 | 8.86 | 2.1596 |
| Xeno Parent 2 | 27.75 | 16.26 | 11.48 | 0.3489 |
| Xeno VEGF 1 | 27.93 | 17.58 | 10.35 | 0.7689 |
| Xeno VEGF 2 | 26.34 | 15.99 | 10.35 | 0.7662 |
| Spleen | 22.25 | 15.97 | 6.29 | 12.8241 |
| Heart | 20.98 | 12.94 | 8.04 | 3.7994 |
| Kidney | 21.9 | 14.26 | 7.64 | 5.0134 |
| Colon | 22.23 | 16.34 | 5.89 | 16.8046 |
| VEGF 1 | 27.1 | 19.11 | 7.99 | 3.9334 |
| VEGF 2 | 26.56 | 17.22 | 9.34 | 1.543 |
| P1 | 26.39 | 16.74 | 9.64 | 1.249 |
| P2 | 27.45 | 17.26 | 10.2 | 0.8531 |

TABLE 19

EXPRESSION OF 17903 IN XENOGRAFT CELL LINES

| Tissue Type | Mean | β2 Mean | δδCt | Expression |
|---|---|---|---|---|
| MCF-7 Breast Tumor | 23.25 | 18.67 | 4.58 | 41.96 |
| ZR75 Breast Tumor | 24.02 | 21.18 | 2.85 | 138.70 |
| T47D Breast Tumor | 23.55 | 18.86 | 4.68 | 38.88 |
| MDA 231 Breast Tumor | 23.59 | 17.86 | 5.74 | 18.71 |
| MDA 435 Breast Tumor | 22.97 | 17.66 | 5.3 | 25.30 |
| SKBr3 Breast | 25.13 | 20.4 | 4.74 | 37.55 |
| DLD 1 Colon Tumor (stage C) | 22.07 | 20.7 | 1.37 | 388.23 |
| SW480 Colon Tumor (stage B) | 25.62 | 21.55 | 4.08 | 59.33 |
| SW620 Colon Tumor (stage C) | 22.59 | 18.91 | 3.68 | 78.02 |
| HCT116 | 25.93 | 22.16 | 3.77 | 73.30 |
| HT29 | 22.34 | 17.55 | 4.79 | 36.27 |
| Colo 205 | 22.11 | 16.36 | 5.75 | 18.58 |
| NCIH125 | 22.97 | 20.02 | 2.94 | 129.86 |
| NCIH67 | 25.41 | 20.88 | 4.53 | 43.43 |
| NCIH322 | 24.07 | 21.07 | 3 | 124.57 |
| NCIH460 | 24.22 | 19.88 | 4.34 | 49.55 |
| A549 | 24.65 | 21.9 | 2.75 | 149.17 |
| NHBE | 24.96 | 21.27 | 3.69 | 77.75 |
| SKOV-3 ovary | 22.68 | 17.74 | 4.93 | 32.69 |
| OVCAR-3 ovary | 25.09 | 21.07 | 4.02 | 61.64 |
| 293 Baby Kidney | 24.31 | 21.11 | 3.2 | 108.82 |
| 293T Baby Kidney | 25.39 | 22.84 | 2.55 | 170.76 |

TABLE 20

EXPRESSION OF 17903 IN HUMAN TISSUES

| Tissue | Mean | 18S Mean | δCt | Expression |
|---|---|---|---|---|
| Adrenal Gland | 28.20 | 14.33 | 13.87 | 0.07 |
| Brain | 28.07 | 13.48 | 14.59 | 0.04 |
| Heart | 27.32 | 14.34 | 12.98 | 0.12 |
| Kidney | 26.85 | 14.36 | 12.49 | 0.17 |
| Liver | 28.62 | 14.24 | 14.39 | 0.05 |
| Lung | 27.26 | 15.30 | 11.96 | 0.25 |
| Mammary Gland | 27.10 | 14.42 | 12.68 | 0.15 |
| Pancreas | 28.73 | 16.08 | 12.65 | 0.16 |
| Placenta | 27.88 | 15.70 | 12.18 | 0.22 |
| Prostate | 28.35 | 14.94 | 13.41 | 0.09 |
| Salivary Gland | 28.28 | 14.88 | 13.40 | 0.09 |
| Muscle | 27.77 | 14.89 | 12.89 | 0.13 |
| Sm. Intestine | 28.12 | 15.02 | 13.10 | 0.11 |
| Spleen | 27.48 | 14.91 | 12.57 | 0.17 |
| Stomach | 27.85 | 14.68 | 13.17 | 0.11 |
| TesteS | 27.58 | 14.36 | 13.22 | 0.10 |
| Thymus | 27.45 | 14.09 | 13.36 | 0.10 |
| Trachea | 27.96 | 15.05 | 12.91 | 0.13 |

TABLE 20-continued

EXPRESSION OF 17903 IN HUMAN TISSUES

| Tissue | Mean | 18S Mean | δCt | Expression |
|---|---|---|---|---|
| Uterus | 28.78 | 14.81 | 13.97 | 0.06 |
| Spinal Cord | 28.32 | 14.90 | 13.42 | 0.09 |
| Skin | 28.63 | 15.20 | 13.43 | 0.09 |
| DRG | 29.80 | 15.56 | 14.24 | 0.05 |

TABLE 21

EXPRESSION OF 17903 IN HUMAN TISSUES

| Tissue | Mean | β2M803 Mean | δCt | Expression |
|---|---|---|---|---|
| Adrenal Gland | 23.19 | 18.53 | 4.66 | 39.55 |
| Brain | 23.07 | 20.14 | 2.93 | 131.21 |
| Heart | 22.88 | 19.15 | 3.73 | 75.36 |
| Kidney | 21.43 | 18.06 | 3.37 | 96.72 |
| Liver | 24.14 | 19.08 | 5.07 | 29.87 |
| Lung | 22.68 | 16.82 | 5.87 | 17.16 |
| Mammary Gland | 21.68 | 17.30 | 4.39 | 47.86 |
| Placenta | 22.03 | 18.37 | 3.67 | 78.84 |
| Prostate | 22.48 | 17.68 | 4.80 | 35.90 |
| Salivary Gland | 22.96 | 18.73 | 4.23 | 53.29 |
| Muscle | 22.20 | 20.53 | 1.68 | 313.17 |
| Sm. Intestine | 22.62 | 18.38 | 4.24 | 52.92 |
| Spleen | 21.68 | 16.44 | 5.25 | 26.37 |
| Stomach | 22.56 | 18.04 | 4.52 | 43.74 |
| Teste | 22.13 | 19.60 | 2.53 | 173.14 |
| Thymus | 22.54 | 18.10 | 4.45 | 45.91 |
| Trachea | 22.97 | 19.05 | 3.92 | 66.29 |
| Uterus | 24.06 | 18.30 | 5.76 | 18.45 |
| Spinal Cord | 23.07 | 18.84 | 4.24 | 53.11 |
| Skin | 23.87 | 16.99 | 6.88 | 8.49 |
| DRG | 25.21 | 18.80 | 6.42 | 11.72 |

TABLE 22

EXPRESSION OF 17903 IN HUMAN CARDIOVASCULAR TISSUE

| Tissue Type | Mean | β2 Mean | δδCt | Expression |
|---|---|---|---|---|
| Fetal Heart/normal/BWH 4 | 23.08 | 17.07 | 6.01 | 15.5171 |
| Heart/Normal/Atrium/MPI 1097 | 25.21 | 19.23 | 5.99 | 15.7883 |
| Heart/Normal/Atrium/PIT 277 | 22.35 | 15.49 | 6.86 | 8.6086 |
| Heart/Normal/Ventricle/PIT 272 | 22.84 | 16.3 | 6.54 | 10.7464 |
| Heart/Normal/Ventricle/TLO 1 | 26.04 | 19.27 | 6.76 | 9.1946 |
| Heart/Normal/Ventricle/PIT 278 | 23.18 | 16.45 | 6.74 | 9.3553 |
| Heart/Normal/Ventricle/PIT 204 | 21.68 | 16.52 | 5.17 | 27.8728 |
| Heart/Normal/Ventricle/PIT 205 | 22.45 | 16.54 | 5.91 | 16.6308 |
| Heart/Diseased/Ventricle/ELI 5 | 21.12 | 15.66 | 5.46 | 22.7183 |
| Heart/Diseased/Ventricle/PIT 16 | 23.21 | 16.16 | 7.04 | 7.5726 |
| Kidney/normal/NDR 171 | 27.46 | 19.68 | 7.78 | 4.5497 |
| Kidney/normal/NDR 179 | 24.32 | 16.8 | 7.53 | 5.4294 |
| Kidney/normal/PIT 289 | 27.23 | 19.93 | 7.29 | 6.3678 |
| Kidney/normal/PIT 351 | 26.25 | 17.52 | 8.73 | 2.3551 |
| Kidney/normal/PIT 353 | 27.18 | 17.36 | 9.82 | 1.1063 |
| Kidney/HT/NDR 233 | 26.54 | 18.21 | 8.32 | 3.1184 |
| Kidney/HT/NDR 224 | 24.46 | 16.36 | 8.1 | 3.6447 |
| Kidney/HT/NDR 248 | 25.91 | 17.98 | 7.93 | 4.0863 |
| Skeletal Muscle/Normal/MPI 570 | 27.16 | 18.07 | 9.09 | 1.8414 |
| Skeletal Muscle/Normal/PIT 284 | 26.36 | 19.13 | 7.24 | 6.6382 |
| Liver/Normal/MPI 155 | 29.1 | 15.64 | 13.46 | 0.0887 |
| Liver/Normal/MPI 146 | 23.77 | 16.11 | 7.66 | 4.9615 |

TABLE 23

17903 EXPRESSION IN NORMAL HUMAN TISSUES

| Tissue Type | Relative Expression |
|---|---|
| Prostate | 7.2 |
| Prostate | 16.5 |
| Liver | 3.7 |
| Liver | 18.4 |
| Breast | 3.9 |
| Breast | 17.8 |
| Skeletal Mucsle | 11.4 |
| Skeletal Mucsle | 48.0 |
| Brain | 44.9 |
| Brain | 10.7 |
| Colon | 8.6 |
| Colon | 8.2 |
| Heart | 35.0 |
| Heart | 11.1 |
| Ovary | 2.0 |
| Ovary | 1.0 |
| Kidney | 6.3 |
| Kidney | 8.5 |
| Lung | 8.3 |
| Lung | 5.1 |
| Vein | 6.0 |
| Vein | 2.9 |
| Aorta | 13.3 |
| Testis | 20.1 |
| Testis | 6.8 |
| Thyroid | 10.4 |
| Thyroid | 7.6 |
| Placenta | 5.6 |
| Placenta | 6.0 |
| Fetal Kidney | 10.0 |
| Fetal Kidney | 70.0 |
| Fetal Liver | 9.1 |
| Fetal Liver | 38.6 |
| Fetal heart | 29.3 |
| Fetal heart | 2.2 |
| Osteoblasts (undif.) | 14.0 |
| Osteoblasts (dif.) | 8.4 |
| Small Intestine | 5.6 |
| Cervix | 1.4 |
| Spleen | 4.0 |
| Esoghagus | 1.3 |
| Thymus | 5.4 |
| Tonsil | 8.9 |
| Lymphnote | 10.2 |

TABLE 24

EXPRESSION OF 17903 IN HUMAN TISSUES

| Tissue Type | Mean | β2 Mean | δδCt | Expression |
|---|---|---|---|---|
| Artery normal | 31.77 | 22 | 9.77 | 1.1493 |
| Vein normal | 30.97 | 20.05 | 10.91 | 0.5179 |
| Aortic Smooth Muscle Cells (SMC) EARLY | 24.32 | 19.65 | 4.68 | 39.0103 |
| Coronary SMC | 25.4 | 21.81 | 3.59 | 83.0429 |
| Static HUVEC | 23.84 | 20.57 | 3.27 | 103.3063 |
| Shear HUVEC | 23.43 | 20.75 | 2.67 | 156.5831 |
| Heart normal | 23.7 | 18.79 | 4.92 | 33.0318 |
| Heart CHF | 23.23 | 19.11 | 4.13 | 57.3128 |
| Kidney | 24.99 | 20.45 | 4.54 | 42.837 |
| Skeletal Muscle | 25.81 | 21.19 | 4.62 | 40.6669 |
| Adipose normal | 24.99 | 19.39 | 5.61 | 20.546 |
| Pancreas | 25.39 | 21.57 | 3.82 | 70.8052 |
| primary osteoblasts | 24.99 | 19.22 | 5.78 | 18.2621 |
| Osteoclasts (diff) | 24.43 | 17.65 | 6.78 | 9.0995 |
| Skin normal | 26.47 | 21.09 | 5.38 | 24.097 |
| Spinal cord normal | 25.52 | 19.83 | 5.68 | 19.4377 |
| Brain Cortex normal | 25.04 | 21.11 | 3.92 | 65.8351 |
| Brain Hypothalamus normal | 26.26 | 21.02 | 5.24 | 26.4608 |
| Nerve | 30.57 | 24.23 | 6.34 | 12.3444 |
| DRG (Dorsal Root Ganglion) | 27.47 | 21.82 | 5.66 | 19.8461 |
| Glial Cells (Astrocytes) | 26.15 | 22.12 | 4.03 | 61.2138 |
| Glioblastoma | 23.82 | 18.09 | 5.73 | 18.8407 |
| Breast normal | 26.73 | 20.53 | 6.2 | 13.6024 |
| Breast tumor | 23.97 | 18.27 | 5.7 | 19.3034 |
| Ovary normal | 26.52 | 20.1 | 6.42 | 11.6785 |
| Ovary Tumor | 28.26 | 20.02 | 8.24 | 3.3076 |
| Prostate Normal | 25.3 | 19.53 | 5.76 | 18.3892 |
| Prostate Tumor | 23.71 | 17.86 | 5.86 | 17.277 |
| Epithelial Cells (Prostate) | 25.22 | 21.23 | 3.99 | 62.9347 |
| Colon normal | 24.2 | 18.15 | 6.05 | 15.0928 |
| Colon Tumor | 23.48 | 18.85 | 4.63 | 40.2463 |
| Lung normal | 26.18 | 18.38 | 7.8 | 4.4716 |
| Lung tumor | 24.02 | 18.56 | 5.46 | 22.7183 |
| Lung chronic obstructive pulmonary disease | 24.15 | 18.48 | 5.67 | 19.5729 |
| Colon IBD | 24.32 | 18.11 | 6.21 | 13.5084 |
| Liver normal | 26.19 | 20.11 | 6.08 | 14.7822 |
| Liver fibrosis | 26.9 | 21.74 | 5.16 | 28.0666 |
| Dermal Cells-fibroblasts | 24.2 | 19.41 | 4.79 | 36.0214 |
| Spleen normal | 25.63 | 19.55 | 6.08 | 14.8335 |
| Tonsil normal | 22.82 | 17.23 | 5.6 | 20.6173 |
| Lymph node | 24.29 | 18.74 | 5.55 | 21.3444 |
| Small intestine | 26.07 | 19.71 | 6.36 | 12.2167 |
| Skin-Decubitus | 25.95 | 20.74 | 5.21 | 27.1106 |
| Synovium | 27.08 | 20.53 | 6.55 | 10.6722 |
| BM-MNC (Bone marrow mononuclear cells) | 21.7 | 17.05 | 4.66 | 39.6922 |
| Activated PBMC | 23.09 | 16.14 | 6.95 | 8.088 |

TABLE 25

EXPRESSION OF 17903 IN HUMAN VESSEL TISSUES

| Tissue Type | Mean | β2 Mean | δδ Ct | Expression |
|---|---|---|---|---|
| Aortic SMC (Early) | 26.27 | 20.98 | 5.29 | 25.65 |
| Aortic SMC (Late) | 26.56 | 21.91 | 4.64 | 40.11 |
| HMVEC | 24.34 | 19.6 | 4.74 | 37.55 |
| Human Umbilical Vein Endothelial Cells (HUVEC) Confluent | 21.48 | 17.09 | 4.39 | 47.70 |
| HUVEC IL 1 | 21.67 | 16.72 | 4.96 | 32.24 |
| Adipose/MET 9 | 28.57 | 23.39 | 5.18 | 27.49 |
| Artery/Normal/Carotid/CLN 595 | 28.98 | 19.27 | 9.71 | 1.19 |
| Artery/Normal/Carotid/CLN 598 | 29.8 | 20.16 | 9.63 | 1.26 |
| Artery/normal/NDR 352 | 27.94 | 20.06 | 7.88 | 4.25 |
| Artery/Normal/Muscular/AMC 198 | 28.43 | 20.86 | 7.58 | 5.23 |
| Artery/Normal/AMC 150 | 39.35 | 21.79 | 17.57 | 0.00 |
| Artery/Normal/AMC 73 | 38.26 | 24.69 | 13.57 | 0.00 |
| Artery/Diseased/iliac/NDR 753 | 26.32 | 19.27 | 7.05 | 7.52 |
| Artery/Diseased/Tibial/PIT 679 | 31.79 | 20.83 | 10.96 | 0.50 |
| Aorta/Diseased/PIT 732 | 30.81 | 22.68 | 8.13 | 3.57 |
| Vein/Normal/Saphenous/AMC 69 | 30.23 | 21.67 | 8.56 | 2.64 |
| Vein/Normal/Saphenous/NDR 724 | 26.14 | 18.34 | 7.79 | 4.50 |
| Vein/Normal/Saphenous/NDR 721 | 23.94 | 17.27 | 6.67 | 9.85 |
| Vein/Normal/SaphenousAMC 107 | 31.79 | 21.5 | 10.29 | 0.80 |
| Vein/Normal/NDR 239 | 31.07 | 21.17 | 9.89 | 1.05 |
| Vein/Normal/Saphenous/NDR 237 | 28.27 | 19.79 | 8.48 | 2.80 |
| Vein/Normal/NDR 235 | 31.23 | 22.81 | 8.43 | 2.91 |
| Vein/Normal/MPI 1101 | 38.8 | 19.07 | 19.73 | 0.00 |
| Vein/Diseased/Saphenous/AMC 70 | 25.61 | 19.02 | 6.59 | 10.34 |

TABLE 26

EXPRESSION OF RAT 17903 IN RAT TISSUES

| Tissue | Mean | HK Mean | δCt | Expression |
|---|---|---|---|---|
| Brain | 26.12 | 14.99 | 11.14 | 0.22 |
| Cortex | 27.46 | 15.20 | 12.26 | 0.10 |
| Striatum | 26.25 | 15.06 | 11.20 | 0.21 |
| Thalamus | 26.35 | 15.00 | 11.36 | 0.19 |
| Cerebellum | 26.04 | 15.18 | 10.87 | 0.26 |
| Brain Stem | 25.62 | 15.08 | 10.54 | 0.33 |
| Dorsal Nuclei | 26.27 | 15.30 | 10.97 | 0.24 |
| Spinal cord | 25.31 | 15.05 | 10.26 | 0.40 |
| TRG | 26.29 | 15.24 | 11.05 | 0.23 |
| DRG | 27.22 | 15.28 | 11.95 | 0.12 |
| SCG | 26.92 | 15.50 | 11.42 | 0.18 |
| Sciatic Nerve | 25.03 | 15.25 | 9.78 | 0.55 |
| Hairy Skin | 26.19 | 15.50 | 10.70 | 0.29 |
| Gastro Muscle | 25.12 | 15.47 | 9.65 | 0.60 |
| Heart | 24.74 | 15.29 | 9.45 | 0.70 |
| Kidney | 26.16 | 15.90 | 10.26 | 0.40 |
| Liver | 26.29 | 15.31 | 10.98 | 0.24 |
| Lung | 25.03 | 15.19 | 9.84 | 0.53 |

TABLE 27

EXPRESSION OF RAT 17903 IN RAT TISSUES

| Tissue | Mean | 18S Mean | δCT | Expression |
|---|---|---|---|---|
| Naïve DRG | 25.12 | 12.63 | 12.50 | 0.17 |
| I DRG CCI 3 | 26.25 | 13.87 | 12.39 | 0.18 |
| I DRG CCI 7 | 26.13 | 13.50 | 12.63 | 0.15 |
| I DRG CCI 14 | 26.30 | 13.47 | 12.83 | 0.13 |
| I DRG CCI 10 | 26.10 | 13.50 | 12.60 | 0.16 |
| I DRG CCI 28 | 26.05 | 12.84 | 13.21 | 0.10 |
| Naïve DRG | 25.12 | 12.63 | 12.50 | 0.17 |
| I DRG CFA 1 | 25.99 | 12.38 | 13.61 | 0.08 |
| I DRG CFA 3 | 26.13 | 12.92 | 13.21 | 0.10 |
| I DRG CFA 7 | 26.11 | 12.78 | 13.33 | 0.09 |
| I DRG CFA 14 | 27.35 | 13.44 | 13.91 | 0.06 |
| I DRG CFA 28 | 26.28 | 13.04 | 13.24 | 0.10 |
| Naïve DRG | 25.12 | 12.63 | 12.50 | 0.17 |
| I DRG AXT 1 | 25.75 | 12.19 | 13.56 | 0.08 |
| I DRG AXT 3 | 26.06 | 12.62 | 13.45 | 0.09 |
| I DRG AXT 7 | 26.48 | 13.04 | 13.44 | 0.09 |
| I DRG AXT 14 | 26.42 | 12.43 | 13.99 | 0.06 |
| I DRG AXT 28 | 26.15 | 13.99 | 12.16 | 0.21 |

TABLE 28

EXPRESSION OF RAT 17903 IN RAT TISSUES

| Tissue | r17903 | 18S | δCt | Expression |
|---|---|---|---|---|
| Naïve SC | 26.73 | 13.97 | 12.76 | 0.11 |
| I SC CCI 3 | 25.41 | 13.72 | 11.69 | 0.24 |
| I SC CCI 7 | 25.19 | 14.04 | 11.15 | 0.34 |
| I SC CCI 14 | 25.03 | 13.68 | 11.35 | 0.30 |
| Naïve SC | 26.73 | 13.97 | 12.76 | 0.11 |
| I SC CFA 3 | 27.01 | 13.39 | 13.62 | 0.06 |
| I SC CFA 7 | 24.78 | 13.64 | 11.15 | 0.35 |
| I SC CFA 14 | 27.61 | 13.51 | 14.10 | 0.04 |
| I SC CFA 28 | 25.61 | 13.62 | 11.99 | 0.19 |
| Naïve SC | 25.10 | 12.67 | 12.43 | 0.14 |
| I SC AXT 1 | 24.79 | 12.58 | 12.21 | 0.16 |
| I SC AXT 3 | 25.11 | 12.93 | 12.19 | 0.17 |
| I SC AXT 7 | 25.49 | 13.14 | 12.35 | 0.15 |
| I SC AXT 14 | 25.20 | 12.40 | 12.80 | 0.11 |
| I SC AXT 28 | 25.62 | 12.39 | 13.24 | 0.08 |

TABLE 29

EXPRESSION OF 17903

| Tissue | Average | HK Average | δCT | Relative Expression |
|---|---|---|---|---|
| MK Cortex | 23.08 | 21.375 | 1.705 | 0.17504337 |
| MK DRG | 23.41 | 17.99 | 5.42 | 0.01332967 |
| MK Spinal Chord | 22.415 | 19.135 | 3.28 | 0.0587521 |
| MK Sciatic Nerve | 21.305 | 17.85 | 3.455 | 0.0520407 |
| MK Kidney | 21.49 | 18.155 | 3.335 | 0.05655445 |
| MK hairy skin | 21.02 | 18.95 | 2.07 | 0.13591573 |
| MK heart LV | 21.34 | 17.965 | 3.375 | 0.05500796 |
| MK gastro muscle | 21.225 | 19.165 | 2.06 | 0.13686109 |
| MK liver | 22.175 | 18.48 | 3.695 | 0.04406522 |
| MK gastro muscle | 21.34 | 19.21 | 2.13 | 0.13037908 |
| Human brain | 21.475 | 19.33 | 2.145 | 0.12903052 |
| Human spinal chord | 22.29 | 18.615 | 3.675 | 0.04468035 |
| Human Kidney | 21.32 | 18.165 | 3.155 | 0.06406962 |
| Human Liver | 23.055 | 18.305 | 4.75 | 0.02120847 |
| Human Lung | 21.31 | 16.12 | 5.19 | 0.0156335 |

Human 3700

The invention is based, at least in part, on the discovery of a novel protein kinase, herein referred to as "3700". The human 3700 cDNA sequence (SEQ ID NO:43), which is approximately 3353 nucleotide residues long including non-translated regions, contains a predicted methionine-initiated coding sequence of about 1884 nucleotide residues, excluding termination codon (i.e., nucleotide residues 157-2040 of SEQ ID NO:43; also shown in SEQ ID NO:45). The coding sequence encodes a 628 amino acid protein having the amino acid sequence SEQ ID NO:44.

Human 3700 contains the following regions or other structural features: a predicted pkinase domain (PF00069) at about amino acid residues 53-303 of SEQ ID NO:44, a protein kinases ATP-binding region signature sequence at residues 59 to 67 of SEQ ID NO:44, and a serine/threonine protein kinase active site signature sequence at residues 171 to 183 of SEQ ID NO:44. A transmembrane domain is predicted at about amino acid residues 234 to 250 of SEQ ID NO:44.

The human 3700 protein has predicted N-glycosylation sites (Pfam accession number PS00001) at about amino acid residues 121-124 and 576-579 of SEQ ID NO:44; predicted cAMP-/cGMP-dependent protein kinase phosphorylation sites (Pfam accession number PS00004>at about amino acid residues 290-293, 337-340, and 413-416 of SEQ ID NO:44; predicted protein kinase C phosphorylation sites (Pfam accession number PS00005) at about amino acid residues 30-32, 74-76, 82-84, 122-124, 142-144, 148-150, 289-291, 327-329, 339-341, 373-375, 377-379, and 616-618 of SEQ ID NO:44; predicted casein kinase II phosphorylation sites (Pfam accession number PS00006) located at about amino acid residues 15-18, 133-136, 148-151, 227-230, 293-296, 331-334, 377-380, 391-394, 461-464, 511-514, 523-526, 578-581, and 606-609 of SEQ ID NO:44; a predicted tyrosine kinase phosphorylation site at residues 453-460 of SEQ ID NO:44; predicted N-myristoylation sites (Pfam accession number PS00008) at about amino acid residues 320-325, 347-352, and 360-365 of SEQ ID NO:44; and a predicted cell attachment sequence at about amino acid residues 134-136 of SEQ ID NO:44.

Polypeptides of the invention include fragments which include: all or part of a hydrophobic sequence, e.g., the sequence of about residues 234-250 of SEQ ID NO:44; all or part of a hydrophilic sequence, e.g., the sequence of residues 40-55 or 445-470 of SEQ ID NO:44; a sequence which includes a cysteine residue; or a glycosylation site.

For general information regarding PFAM identifiers, PS prefix and PF prefix domain identification numbers, refer to Sonnhammer et al. (1997, Protein 28:405-420).

The 3700 protein contains a significant number of structural characteristics in common with members of the Protein Kinase family. Protein phosphorylation is influenced primarily by enzymes of two types, namely protein kinases (PKs) and protein phosphatases (PPs). PKs catalyze addition of a phosphate moiety to a protein amino acid residue (generally a serine, threonine, or tyrosine residue), and PPs catalyze removal of such moieties. The catalytic activities of PKs and PPs are, in turn, influenced by the state of the cell and the environment in which it finds itself. Phosphorylation of amino acid residues by a PK generally manifests itself in the form of faster cell growth, metabolism, or division, as greater motility, or in the form of higher gene transcription, although certain physiological processes are inhibited by protein phosphorylation. De-phosphorylation of amino acid residues by a PP, by contrast, generally manifests itself as slower (or halted) cell growth, division, or metabolism, as lower motility, or in the form of lower gene transcription. PK/PP-modulated protein phosphorylation is also involved in carcinogenesis.

Without being bound by any particular theory of operation, 3700 protein is believed to be a serine/threonine kinase.

A 3700 polypeptide can include a pkinase domain. As used herein, the term "pkinase domain" refers to a protein domain having an amino acid sequence of about 200-300 amino acid residues in length, preferably, at least about 225-300 amino acids, more preferably about 278 amino acid residues or about 251 amino acid residues and has a bit score for the alignment of the sequence to the pkinase domain (HMM) of at least 100 or greater, preferably 200 or greater, and more preferably 300 or greater. The pkinase domain has been assigned the PFAM accession PF00069.

In a preferred embodiment, 3700 polypeptide or protein has a pkinase domain or a region which includes at least about 200-300, more preferably about 225-300, 278, or 251 amino acid residues and has at least about 60%, 70%, 80%, 90%, 95%, 99%, or 100% homology with a pkinase domain, e.g., the pkinase domain of human 3700 (e.g., residues 53-303 of SEQ ID NO:44).

To identify the presence of a pkinase domain profile in a 3700 receptor, the amino acid sequence of the protein is searched against a database of HMMs (e.g., the Pfam database, release 2.1) using the default parameters. For example, the hmmsf program, which is available as part of the HMMER package of search programs, is a family specific default program for PF00069 and score of 100 is the default threshold score for determining a hit. For example, using ORFAnalyzer software, a pkinase domain profile was identified in the amino acid sequence of SEQ ID NO:44 (e.g., amino acids 53-303 of SEQ ID NO:44). Accordingly, a 3700 protein having at least about 60-70%, more preferably about 70-80%, or about 80-90% homology with the pkinase domain profile of human 3700 is within the scope of the invention.

In one embodiment, a 3700 protein includes at least one transmembrane domain. As used herein, the term "transmembrane domain" includes an amino acid sequence of about 5 amino acid residues in length that spans the plasma membrane. More preferably, a transmembrane domain includes about at least 10, 15, 20 or 22 amino acid residues and spans a membrane. Transmembrane domains are rich in hydrophobic residues, and typically have an alpha-helical structure. In a preferred embodiment, at least 50%, 60%, 70%, 80%, 90%, or 95% or more of the amino acids of a transmembrane domain are hydrophobic, e.g., leucines, isoleucines, tyrosines, or tryptophans. Transmembrane domains are described in, for example, Zagotta W. N. et al. (1996, Annu. Rev. Neurosci. 19: 235-263), the contents of which are incorporated herein by reference. Amino acid residues 234 to about 250 of SEQ ID NO:44 comprise a transmembrane domain in a 3700 protein. In one embodiment, the amino-terminal domain of 3700 protein (i.e., about residues 1-233 of SEQ ID NO:44) is on the cytoplasmic side of a cellular membrane (e.g., the nuclear membrane or the cytoplasmic membrane) and the carboxyl-terminal domain (i.e., about residues 251-628 of SEQ ID NO:44) is on the non-cytoplasmic side of the same membrane. In another embodiment, the amino-terminal domain is oriented on the non-cytoplasmic side of the membrane and the carboxyl-terminal domain is oriented on the cytoplasmic side.

While not being bound by any particular theory of operation, 3700 protein is believed to be, in at least one embodiment, a nuclear membrane protein having its carboxyl-terminal domain oriented within the nuclear envelope. In this embodiment, 3700 protein is capable of transmitting signaling information from the cytoplasm to the nucleus, whereby, for example, gene transcription can be regulated.

In one embodiment of the invention, a 3700 polypeptide includes at least one pkinase domain. In another embodiment, the 3700 polypeptide includes at least one pkinase domain and at least one transmembrane domain. The 3700 molecules of the present invention can further include one or more of the N-glycosylation, cAMP-/cGMP-dependent protein kinase phosphorylation, protein kinase C phosphorylation, casein kinase II phosphorylation, tyrosine kinase phosphorylation, N-myristoylation, and cell attachment sites described herein, and preferably comprises most or all of them.

Because the 3700 polypeptides of the invention can modulate 3700-mediated activities, they can be used to develop novel diagnostic and therapeutic agents for 3700-mediated or related disorders, as described below.

As used herein, a "3700 activity," "biological activity of 3700," or "functional activity of 3700," refers to an activity exerted by a 3700 protein, polypeptide or nucleic acid molecule on, for example, a 3700-responsive cell or on a 3700 substrate (e.g., a protein substrate) as determined in vivo or in vitro. In one embodiment, a 3700 activity is a direct activity, such as association with a 3700 target molecule. A "target molecule" or "binding partner" of a 3700 protein is a molecule (e.g., a protein or nucleic acid) with which the 3700 protein binds or interacts in nature. In an exemplary embodiment, such a target molecule is a 3700 receptor. A 3700 activity can also be an indirect activity, such as a cellular signaling activity mediated by interaction of the 3700 protein with a 3700 receptor.

The 3700 molecules of the present invention are predicted to have similar biological activities as PK family members. For example, the 3700 proteins of the present invention can have one or more of the following activities: (1) catalyzing formation of a covalent bond within or between an amino acid residue (e.g., a serine or threonine residue) and a phosphate moiety; (2) modulating cell signaling; (3) modulating cell growth; (4) modulating cell differentiation; (5) modulating tumorigenesis; (6) modulating entry of a cell into the cell cycle; (7) modulating progression of a cell through the cell cycle; (8) modulating mitogenesis; (9) modulating cell motility; (10) modulating a cell-to-cell interaction; (11) modulating cell metabolism; (12) modulating gene transcription; (13) modulating an immune response; (14) modulating angiogenesis; (15) modulating tissue (e.g., kidney or liver) repair or regeneration; (16) modulating establishment of atherosclerosis; (17) modulating progression of atherosclerosis; and (18) modulating signaling across the blood-brain barrier.

Thus, 3700 molecules described herein can act as novel diagnostic targets and therapeutic agents for prognosticating, diagnosing, preventing, inhibiting, alleviating, or curing PK-related disorders.

Other activities, as described below, include the ability to modulate function, survival, morphology, proliferation and/or differentiation of cells of tissues in which 3700 molecules are expressed. Thus, the 3700 molecules can act as novel diagnostic targets and therapeutic agents for controlling disorders involving aberrant activities of these cells.

The 3700 molecules can also act as novel diagnostic targets and therapeutic agents for controlling cellular proliferative and/or differentiative disorders (e.g., hematopoietic neoplastic disorders, carcinoma, sarcoma, metastatic disorders or hematopoietic neoplastic disorders, e.g., leukemias. A metastatic tumor can arise from a multitude of primary tumor types, including but not limited to those of prostate, colon, lung, breast and liver origin.

Expression data included herein indicate that 3700 is highly expressed in tissues having endothelial or epithelial cell layers, such as in blood vessels, kidney, and pancreas. These data indicate that 3700 protein can be involved in a variety of disorders that afflict endothelial and epithelial tissues. Examples of such disorders include cardiovascular disorders such as atherosclerosis, arteriosclerosis, abnormal blood coagulation, and coronary artery disease.

3700 is expressed in aortic and coronary smooth muscle cells, indicating that 3700 can have a role in disorders that affect these tissues. Examples of these disorders include coronary artery disease and cardiac insufficiency. 3700 can also be involved in the response of aortic and coronary tissues to ischemic damage, such as that associated with cardiac infarction or thrombotic injury to coronary arteries.

Expression of 3700 is enhanced in the presence of inflammatory cytokines, indicating a role for 3700 in normal and aberrant inflammatory responses. 3700 can have a role in a variety of immune disorders in tissues in which it is expressed. By way of example, 3700 can have a role in prostatitis, pancreatitis, meningitis, severe allergic reactions, and in autoimmune disorders. Modulating the activity or expression of 3700 can affect the severity of the immune disorder.

Expression of 3700 increases with age in transgenic mice in which the apoE gene has been silenced. The apoE mouse is an accepted model of atherosclerosis, and genes that are upregulated in that model often have a role in establishment or progression of atherosclerosis. Inflammatory cytokines are also known to enhance expression of genes (e.g., those encoding VCAM and E-selectin) that are associated with establishment and progression of atherosclerosis. These observations indicate that 3700 is involved in atherosclerosis in humans, and the establishment and progression of atherosclerosis in humans can be modulated by modulating one or both of expression and activity of 3700. Expression of 3700 appears to be enhanced earlier than other known inflammatory effector molecules, indicating that inhibition of activity or expression of 3700 may have a more beneficial effect than therapeutic methods involving the other known inflammatory effector molecules.

The significant expression of 3700 in kidney tissues indicates a role for 3700 in the normal and aberrant functions of kidney tissues. Various kidney disorders can be associated with aberrant activity or expression of 3700. Examples of these kidney-related disorders in which 3700 can have a role include pancreatitis, endocrine and exocrine tumors of the pancreas, diabetes, pancreatic abscesses, pancreatic fibrocystic disease, and pancreatic cholera.

Expression of 3700 activity in astrocytes indicates that 3700 can have a significant role in modulating signaling between the blood and brain/central nervous system compartments. Ability of 3700 to contact molecules that are present in the bloodstream or in the cerebrospinal fluid and to modulate the phosphorylation state of a protein in response to such contact permits passage of a signal from one compartment to the other without the necessity for passage of a large molecule between the compartments. Regulation of 3700 expression by inflammatory cytokines indicates that 3700 protein can interact with relatively small peptide effectors which normally or aberrantly occur in blood or cerebrospinal fluid. Thus, modulation of 3700 activity or expression permits one to affect passage of signals between the blood and brain compartments.

Expression of 3700 in arterial tissue indicates that 3700 can have a role in formation of new blood vessels (angiogenesis), such as that associated with establishment or reestablishment of blood supply to a tumor or a wounded tissue. Higher levels of 3700 expression were detected in lung, colon, ovarian, and breast tumors than in the corresponding normal tissues. These observations indicate that 3700 can enhance establishment and increase of blood supply to tumors and other rapidly-growing tissues (e.g., traumatized arterial endothelium) and that modulation of 3700 activity, expression, or both, can limit establishment and increase of blood supply to such tissues.

3700 was more highly expressed in diseased liver tissue (e.g., liver tissue obtained from patients with fibrosed or HBV-infected livers) than in normal liver tissues. These observations indicate that 3700 can modulate liver tissue repair and that 3700 can also serve as an indicator of liver tissue damage. Increased expression of 3700 in damaged or diseased liver tissue indicates that such tissues are better able than non-damaged liver to react to the presence of inflammatory cytokines (e.g., inducing apoptosis of seriously damaged liver cells or increased attraction of cells which induce regeneration or repair of liver tissue) and that such tissues direct increased blood supply, relative to non-damaged liver tissues. These functions can be more generally applicable, meaning that increased expression of 3700 in cells of a non-liver tissue can enhance blood supply to the tissue and can enhance repair or regeneration of the tissue.

Modulation of 3700 activity, expression, or both can be used to inhibit, prevent, alleviate, or cure the disorders discussed herein. Furthermore, assessment of the level of 3700 activity, expression, or both, can be used to diagnose or prognosticate these disorders.

Without being bound by any particular theory of operation, it is believed that the ability of 3700 protein to phosphorylate proteins, combined with its transmembrane nature, indicates an ability of 3700 protein to transmit signals from the external environment of the cell to the interior of the cell. Protein phosphorylation (e.g., that associated with G-protein signaling) is known to be a method by which transcription of genes can be modulated in response to extracellular stimuli. 3700 protein can bind molecules (e.g., inflammatory cytokines such as tumor growth factor beta or endothelial growth factor) in the extracellular milieu, undergo a conformational or other change, and exhibit an intracellular protein kinase activity. The intracellularly phosphorylated protein can phosphorylate another protein or affect the conformation or protein-binding-state of a nucleic acid. Thus, directly or indirectly, 3700 can affect the likelihood or rate at which a gene is transcribed, thereby correlating occurrence of an intracellular gene product with the presence of an extracellular signaling molecule. In one embodiment, the membrane in which 3700 protein is embedded is the nuclear membrane, and 3700 protein catalyzes a change in the phosphorylation state of a nuclear membrane protein or an intranuclear protein in response to occurrence of a signaling molecule in the cytoplasm of the cell.

Identification and Characterization of Human 3700 cDNA

The human 3700 nucleotide sequence (SEQ ID NO:43), which is approximately 3353 nucleotides in length including non-translated regions, contains a predicted methionine-initiated coding sequence at about nucleotide residues 157-2040. The coding sequence encodes a 628 amino acid protein (SEQ ID NO:44).

Expression of the 3700 Gene

Tables 30-41 list the results of real time quantitative PCR (TAQMAN®) analyses of 3700 gene expression in selected cells and tissues. In the Tables, "M" means monkey.

TABLE 30

| Tissue Type | Relative Expression of 3700 |
| --- | --- |
| Artery normal | 0 |
| Vein normal | 0 |
| Aortic smooth muscle cells EARLY | 1.76 |
| Coronary smooth muscle cells | 5.66 |
| Static human umbilical vein endothelial cells | 0 |
| Shear human umbilical vein endothelial cells | 1.24 |
| Heart normal | 0 |
| Heart - congestive heart failure | 0 |
| Kidney | 44.3 |
| Skeletal Muscle | 0 |
| Adipose normal | 0 |
| Pancreas | 10.7 |
| primary osteoblasts | 0.60 |
| Osteoclasts (diff) | 0 |
| Skin normal | 0.25 |
| Spinal cord normal | 0 |
| Brain Cortex normal | 0.32 |
| Brain Hypothalamus normal | 0.42 |
| Nerve | 0 |
| Dorsal Root Ganglion | 0 |
| Glial Cells (Astrocytes) | 64.03 |
| Glioblastoma | 0.11 |
| Breast normal | 0 |
| Breast tumor | 0.53 |
| Ovary normal | 0.12 |
| Ovary Tumor | 5.26 |
| Prostate Normal | 0 |
| Prostate Tumor | 0 |
| Prostate Epithelial Cells | 41.1 |
| Colon normal | 0.22 |
| Colon Tumor | 4.96 |
| Lung normal | 0 |
| Lung tumor | 0.70 |
| Lung - chronic obstrucive pulmonary disorder | 0.28 |
| Colon - inflammatory bowel disorder | 0 |
| Liver normal | 0.098 |
| Liver fibrosis | 0.104 |
| Dermal Cells - fibroblasts | 0.56 |
| Spleen normal | 1.01 |
| Tonsil normal | 1.30 |
| Lymph node | 0.66 |
| Small Intestine | 0.15 |
| Skin-Decubitus | 0.56 |
| Synovium | 0 |
| Bone marrow mononuclear cells | 0.48 |
| Activated peripheral blood mononuclear cells | 0 |

TABLE 31

| Tissue Type | Relative Expression of 3700 |
| --- | --- |
| Artery normal | 0.804 |
| Vein normal | 0.331 |
| Aortic smooth muscle cells EARLY | 8.73 |
| Coronary smooth muscle cells | 20.9 |
| Static human umbilical vein endothelial cells | 2.70 |
| Shear human umbilical vein endothelial cells | 3.41 |
| Heart normal | 0.366 |
| Heart - congestive heart failure | 0.280 |
| Kidney | 31.1 |
| Skeletal Muscle | 1.73 |
| Adipose normal | 0.279 |
| Pancreas | 14.9 |
| primary osteoblasts | 2.13 |
| Osteoclasts (diff) | 0.459 |
| Skin normal | 6.66 |
| Spinal cord normal | 1.52 |
| Brain Cortex normal | 4.32 |
| Brain Hypothalamus normal | 5.49 |
| Nerve | 3.45 |
| Dorsal Root Ganglion | 2.56 |
| Resting peripheral blood mononuclear cells | 1.56 |
| Glioblastoma | 1.32 |
| Breast normal | 0.745 |
| Breast tumor | 3.31 |
| Ovary normal | 4.52 |
| Ovary Tumor | 51.7 |
| Prostate Normal | 2.46 |
| Prostate Tumor | 0.950 |
| Epithelial Cells (Prostate) | 52.2 |
| Colon normal | 2.77 |
| Colon Tumor | 17.3 |
| Lung normal | 0.614 |
| Lung tumor | 7.31 |
| Lung - chronic obstrucive pulmonary disorder | 2.51 |
| Colon - inflammatory bowel disorder | 0.308 |
| Liver normal | 2.56 |
| Liver fibrosis | 16.2 |
| Dermal Cells - fibroblasts | 2.09 |
| Spleen normal | 7.09 |
| Tonsil normal | 2.87 |
| Lymph node | 5.05 |
| Small intestine | 2.39 |
| Skin-Decubitus | 3.30 |
| Synovium | 0.475 |
| Bone marrow mononuclear cells | 1.31 |
| Activated peripheral blood mononuclear cells | 0.063 |

TABLE 32

| Tissue Type | Relative Expression of 3700 |
| --- | --- |
| PIT 400 Normal Breast | 0.00 |
| PIT 372 Normal Breast | 0.00 |
| CHT 558 Normal Breast | 0.00 |
| CLN 168 Breast Tumor: IDC | 0.00 |
| MDA 304 Breast Tumor: MD-IDC | 0.33 |
| NDR 58 Breast Tumor: IDC | 1.19 |
| NDR 05 Breast Tumor: IDC | 0.04 |
| CHT 562 Breast Tumor: IDC | 0.00 |
| NDR 138 Breast Tumor ILC (LG) | 32.7 |
| CHT 1841 Lymph node (Breast metastasis) | 0.00 |
| PIT 58 Lung (Breast metastasis) | 0.00 |
| PIT 208 Normal Ovary | 60.2 |
| CHT 620 Normal Ovary | 145 |
| CLN 03 Ovary Tumor | 62.9 |
| CLN 17 Ovary Tumor | 199 |
| MDA 25 Ovary Tumor | 141 |
| MDA 216 Ovary Tumor | 0.00 |
| CLN 012 Ovary Tumor | 0.77 |
| MDA 185 Normal Lung | 11.3 |
| CLN 930 Normal Lung | 21.1 |
| MDA 183 Normal Lung | 33.6 |

TABLE 32-continued

| Tissue Type | Relative Expression of 3700 |
|---|---|
| MPI 215 Lung Tumor -SmC | 10.2 |
| MDA 259 Lung Tumor -PDNSCCL | 0.01 |
| CHT 832 Lung Tumor -PDNSCCL | 36.5 |
| MDA 262 Lung Tumor -SCC | 9.96 |
| CHT 793 Lung Tumor -ACA | 4.47 |
| CHT 331 Lung Tumor -ACA | 50.1 |
| CHT 405 Normal Colon | 0.90 |
| CHT 523 Normal Colon | 1.78 |
| CHT 371 Normal Colon | 0.01 |
| CHT 382 Colon Tumor: MD | 92.5 |
| CHT 528 Colon Tumor: MD | 90.9 |
| CLN 609 Colon Tumor | 9.49 |
| CHT 372 Colon Tumor: MD-PD | 64.0 |
| CHT 340 Colon-Liver metastasis | 33.6 |
| NDR 100 Colon-Liver metastasis | 13.7 |
| PIT 260 Normal Liver (female) | 0.00 |
| CHT 1653 Cervix Squamous CC | 0.00 |
| CHT 569 Cervix Squamous CC | 0.51 |
| A24 HMVEC-Arr | 3.45 |
| C48 HMVEC-Prol | 0.00 |

TABLE 33

Relative 3700 Expression in Breast Tissues

| Breast Tissue Type | Relative Expression of 3700 |
|---|---|
| MCF10MS | 85.7 |
| MCF10A | 0.11 |
| MCF10AT.cl1 | 20.6 |
| MCF10AT.cl3 | 30.5 |
| MCF10AT1 | 14.9 |
| MCF10AT3B | 1.20 |
| MCF10CA1a.cl1 | 0.27 |
| MCF10AT3B Agar | 56.7 |
| MCF10CA1a.cl1 Agar | 2.91 |
| MCF10A.m25 Plastic | 0.38 |
| MCF10CA Agar | 0.26 |
| MCF10CA Plastic | 1.43 |
| MCF3B Plastic | 3.73 |
| MCF10A EGF 0 hr | 0.25 |
| MCF10A EGF 0.5 hr | 0.19 |
| MCF10A EGF 1 hr | 0.08 |
| MCF10A EGF 2 hr | 0.02 |
| MCF10A EGF 4 hr | 0.19 |
| MCF10A EGF 8 hr | 0.21 |
| MCF10A IGF1A 0 hr | 1.14 |
| MCF10A IGF1A 0.5 hr | 0.45 |
| MCF10A IGF1A 1 hr | 0.55 |
| MCF10A IGF1A 3 hr | 1.10 |
| MCF10A IGF1A 24 hr | 1.53 |
| MCF10AT3B.cl5 Plastic | 2.51 |
| MCF10AT3B.cl6 Plastic | 1.86 |
| MCF10AT3B.cl3 Plastic | 2.51 |
| MCF10AT3B.cl1 Plastic | 3.64 |
| MCF10AT3B.cl4 Plastic | 0.37 |
| MCF10AT3B.cl2 Plastic | 2.08 |
| MCF10AT3B.cl5 Agar | 14.8 |
| MCF10AT3B.cl6 Agar | 26.3 |
| MCF-7 | 106 |
| ZR-75 | 78.0 |
| T47D | 28.2 |
| MDA-231 | 14.9 |
| MDA-435 | 3.68 |
| SkBr3 | 24.5 |
| Hs578Bst | 6.68 |
| Hs578T | 0.81 |
| MCF3B Agar | 3.83 |

TABLE 34

| Blood Vessel Tissue Type | Relative Expression of 3700 |
|---|---|
| Aortic SMC | 0.32 |
| HMVEC | 0.00 |
| Human Adipose | 0.00 |
| Human Artery/Normal/Carotid | 0.00 |
| Human Artery/Normal/Carotid | 0.00 |
| Human Artery/Normal/Muscular | 0.00 |
| Artery/Normal | 0.00 |
| Artery/Normal | 0.00 |
| Human Artery/Diseased/iliac | 0.00 |
| Human Artery/Diseased/Tibial | 0.00 |
| Human Aorta/Diseased | 0.00 |
| Human Vein/Normal/Saphenous | 0.00 |
| Human Vein/Normal/Saphenous | 0.00 |
| Human Vein/Normal/Saphenous | 0.00 |
| Human Vein/Normal/Saphenous | 0.00 |
| Human Vein/Diseased/Saphenous | 0.00 |
| Human Vein/Normal/ | 0.00 |
| Human Vein/Normal/Saphenous | 0.00 |
| Human Vein/Normal/ | 0.00 |
| Vein/Normal | 0.00 |
| M/Artery/Normal/Coronary | 0.00 |
| M/Artery/Normal/Coronary | 0.00 |
| M/Artery/Normal/Coronary | 0.00 |
| M/Artery/Normal/Coronary | 0.00 |
| M/Vein/Normal | 0.00 |

TABLE 35

| Tissue Type | Relative Expression of 3700 |
|---|---|
| Human Artery/normal/NDR 352 | 0.373 |
| Human IM Artery/Normal/AMC 73 | 0 |
| Human Muscular Artery/Normal/AMC 236 | 0 |
| Human Muscular Artery/Normal/AMC 247 | 0 |
| Human Aorta/Diseased/PIT 710 | 0.216 |
| Human Aorta/Diseased/PIT 711 | 0.914 |
| Human Aorta/Diseased/PIT 712 | 0.169 |
| Human Artery/Diseased/iliac/NDR 753 | 0.038 |
| Human Artery/Diseased/Tibial/PIT 679 | 0.395 |
| M/Aorta/Normal/MPI 543 | 0 |
| M//Vein/Normal/MPI 536 | 0 |
| M/CAR 1174/Artery/Diseased | 128 |
| M/CAR 1175/Artery/Diseased | 9254 |
| M/PRI 2/Pancreas | 7.60 |
| M/MPI 88/Kidney/Normal | 15830 |
| M/MPI 282/Kidney/Normal | 13090 |

TABLE 36

| Tissue Type | Relative Expression of 3700 |
|---|---|
| Aortic smooth muscle cell | 16.9 |
| Coronary smooth muscle cell | 50.4 |
| Huvec Static | 5.28 |
| Huvec LSS | 24.1 |
| Human Adipose/MET 9 | 0.511 |
| Human Artery/Normal/Carotid/CLN 595 | 1.28 |
| Human Artery/Normal/Carotid/CLN 598 | 1.05 |
| Human Artery/normal/NDR 352 | 2.53 |
| Human IM Artery/Normal/AMC 73 | 0 |
| Human Muscular Artery/Normal/AMC 236 | 0 |
| Human Muscular Artery/Normal/AMC 247 | 0 |
| Human Muscular Artery/Normal/AMC 254/ | 0 |
| Human Muscular Artery/Normal/AMC 259 | 0 |
| Human Muscular Artery/Normal/AMC 261 | 0.874 |
| Human Muscular Artery/Normal/AMC 275 | 0.871 |
| Human Aorta/Diseased/PIT 732 | 4.27 |
| Human Aorta/Diseased/PIT 710 | 0.607 |

TABLE 36-continued

| Tissue Type | Relative Expression of 3700 |
|---|---|
| Human Aorta/Diseased/PIT 711 | 0.442 |
| Human Aorta/Diseased/PIT 712 | 0.665 |
| Human Artery/Diseased/iliac/NDR 753 | 0.143 |
| Human Artery/Diseased/Tibial/PIT 679 | 1.15 |
| Human Vein/Normal/SaphenousAMC 107 | 0.152 |
| Human Vein/Normal/NDR 239 | 0.717 |
| Human Vein/Normal/Saphenous/NDR 237 | 0.638 |
| Human Vein/Normal/PIT 1010 | 0.250 |
| Human Vein/Normal/AMC 191 | 1.25 |
| Human Vein/Normal/AMC 130 | 0.614 |
| Human Vein/Normal/AMC 188 | 0 |
| HUVEC Vehicle | 2.73 |
| HUVEC Mev | 1.60 |
| HAEC Vehicle | 0.571 |
| HAEC Mev | 0.428 |

TABLE 37

| Tissue Type | Relative Expression of 3700 |
|---|---|
| M/CAR 1174/Artery/Diseased | 0 |
| M/CAR 1175/Artery/Diseased | 0 |
| M/PRI 2/Pancreas | 1.31 |
| M/MPI 88/Kidney/Normal | 0 |
| M/MPI 282/Kidney/Normal | 0 |
| Human PIT 289/Kidney/Normal | 20.7 |
| Human NDR 233/Kidney/HT | 8.52 |
| Human NDR 224/Kidney/HT | 19.2 |
| Human NDR 248/Kidney/HT | 26.1 |
| Human MPI 146/Liver/Normal | 0.106 |

TABLE 38

| Tissue Type | Relative Expression of 3700 |
|---|---|
| ONC 101 Hemangioma | 0 |
| ONC 102 Hemangioma | 0.07 |
| ONC 103 Hemangioma | 0 |
| NDR 203 Normal Kidney | 120 |
| PIT 213 Renal Cell Carcinoma | 1.05 |
| CHT 732 Wilms Tumor | 2.93 |
| CHT 765 Wilms Tumor | 9.04 |
| NDR 295 Skin | 3.71 |
| CHT 1424 Uterine Adenocarcinoma | 0.25 |
| CHT 1238 Neuroblastoma | 0.04 |
| BWH 78 Fetal Adrenal | 0 |
| BWH 74 Fetal Kidney | 26.5 |
| BWH 4 Fetal Heart | 0 |
| MPI 849 Normal Heart | 0 |
| CLN 746 Spinal cord | 0.58 |
| CHT 1273 Glioblastoma | 0.27 |
| CHT 216 Glioblastoma | 0.64 |
| CHT 501 Glioblastoma | 4.69 |

TABLE 39

| Tissue Type | Relative Expression of 3700 |
|---|---|
| Conf HMVEC | 0.000 |
| Aortic SMC | 0.211 |
| Human Fetal Heart | 0.000 |
| Human Heart Normal Atrium | 0.000 |
| Human Heart Normal Atrium | 0.000 |
| Human Heart Normal Ventricle | 0.000 |
| Human Heart Normal Ventricle | 0.000 |
| Human Heart Normal Ventricle | 0.000 |
| Human Heart Normal Ventricle | 0.000 |
| Human Heart Normal Ventricle | 0.000 |
| Human Heart Diseased Ventricle | 0.000 |
| Human Heart Diseased Ventricle | 0.000 |
| Human Heart Diseased Ventricle | 0.002 |
| Human Kidney normal | 9.62 |
| Human Kidney normal | 32.0 |
| Human Kidney normal | 7.52 |
| Human Kidney normal | 4.55 |
| Human Kidney normal | 2.03 |
| Human Kidney HT | 5.64 |
| Human Kidney HT | 9.89 |
| Human Kidney HT | 12.9 |
| Human Kidney HT | 8.32 |
| Human Skeletal Muscle | 0.000 |
| Human Skeletal Muscle | 0.001 |
| Human Liver | 0.000 |
| Human Liver | 0.000 |
| Fetal Adrenal Normal | 0.000 |
| Wilms Tumor | 0.793 |
| Wilms Tumor | 0.262 |
| Spinal Cord Normal | 0.006 |
| Cartilage Diseased | 0.016 |
| M Heart Normal Atrium | 0.001 |
| M Heart Normal Atrium | 0.002 |
| M Heart Normal Ventricle | 0.002 |
| M Heart Normal Ventricle | 0.009 |

TABLE 40

| Liver Tissue Type | Relative Expression of 3700 |
|---|---|
| Liver NDR 200 | 20 |
| Liver CHT 339 | 25 |
| Liver Pit 260 | 12 |
| MAI 01 | 14 |
| MAI 10 | 18 |
| Hep C+ 518 | 26 |
| Hep C+ 519 | 54 |
| HepG2 | 174 |
| HepG2.2.15 | 1120 |
| HBV-X Trans con#17 | 202 |
| HBV-X Trans #18 | 426 |
| NT2/KOS 0 hr. | 3340 |
| NT2/KOS 2.5 hr. | 5940 |
| NT2/KOS 5 hr. | 4760 |
| NT2/KOS 7 hr. | 7160 |

TABLE 41

| Tissue Type | Relative Expression of 3700 |
|---|---|
| M/CAR 1174/Artery/Diseased | 1.62 |
| M/CAR 1175/Artery/Diseased | 0.11 |
| M/PRI 2/Pancreas | 44.5 |
| M/MPI 88/Kidney/Normal | 87.8 |
| M/MPI 282/Kidney/Normal | 184 |
| Human/PIT 289/Kidney/Normal | 1110 |
| Human/NDR 233/Kidney/HT | 79.7 |
| Human/NDR 224/Kidney/HT | 151 |
| Human/NDR 248/Kidney/HT | 209 |
| Human/MPI 146/Liver/Normal | 4.20 |

Human 21529

The present invention is based, at least in part, on the identification of novel molecules, referred to herein as "21529", also known as adenylate cyclase nucleic acid and polypeptide molecules, which play a key role in regulation of the cyclic AMP (cAMP) signal transduction pathway by virtue of their conversion of intracellular ATP into cAMP. In one embodiment, the adenylate cyclase molecules modulate the activity of one or more proteins involved in cellular metabolism associated with cell maintenance, growth, or differentiation, e.g., cardiac, epithelial, or neuronal cell maintenance, growth, or differentiation. In another embodiment, the adenylate cyclase molecules of the present invention are capable of modulating the phosphorylation state of one or more proteins involved in cellular metabolism associated with cell maintenance, growth, or differentiation, e.g., cardiac, epithelial, or neuronal cell maintenance, growth or differentiation, via their indirect effect on cAMP-dependent protein kinases, particularly protein kinase A, as described in, for example, Devlin (1997) *Textbook of Biochemistry with Clinical Correlations* (Wiley-Liss, Inc., New York, N.Y.). In addition, the receptors which trigger activity of the adenylate cyclases of the present invention are targets of drugs as described in Goodman and Gilman (1996), *The Pharmacological Basis of Therapeutics* ($9^{th}$ ed.) Hartman & Limbard Editors, the contents of which are incorporated herein by reference. Particularly, the adenylate cyclase molecules of the invention may modulate phosphorylation activity in tissues in which the polypeptides are highly expressed, including but not limited to skeletal muscle, heart, cervix, vein, brain, pancreas, breast, fetal kidney, fetal liver, and fetal heart.

Furthermore, 21529 expression may be modulated in tissues in which the 21529 polypeptides are expressed including, but not limited to, skeletal muscle, heart, cervix, vein, brain, pancreas, breast, fetal kidney, fetal liver, and fetal heart, which provides a profile of expression in normal human tissues. In addition, upregulation is observed in breast carcinoma. Therefore, modulation is particularly relevant in this disorder. Further, 21529 downregulation is shown in both lung and colon carcinoma. Therefore, modulation is also relevant in these tissues. In colonic liver metastases, however, there is significant upregulation. Accordingly, modulation is important in these tissues. Furthermore, 21529 expression occurs in cardiovascular tissues, such as, but are not limited to, aorta, aorta with intimal proliferation (atheroplaques), coronary artery, internal mammary artery, heart, especially heart derived from patients with congestive heart failure and heart tissue derived from myopathic patients, ischemic heart, and saphenous vein, (the chief superficial vein found in the human leg). Finally, as further discussed herein, the 21529 gene is expressed in hypertrophic cardiac myocytes from diseased subjects. Accordingly, 21529 modulation is particularly relevant in disorders that include but are not limited to congestive heart failure, ischemia, hypertension, myocardial infarction, atherosclerosis, cardiomyopathy, and other diseases of the cardiovascular system as disclosed herein.

In a preferred embodiment, the adenylate cyclase molecules of the invention are used to modulate the cyclic AMP (cAMP) signal transduction pathway. Cyclic AMP is a second messenger produced in response to ligand-induced stimulation of certain G-protein-coupled receptors (GPCR). In the cAMP signal transduction pathway, binding of a ligand to a GPCR leads to the activation of adenylate cyclase, which then catalyzes the synthesis of cAMP. The newly synthesized cAMP can in turn activate a cAMP-dependent protein kinase, such as protein kinase A. The activated cAMP-dependent kinases can, through a series of intermediate steps, regulate transcription factors and stimulate expression of target genes, as well as phosphorylate other downstream target proteins that are involved in a host of metabolic pathways. In addition, activated cAMP-dependent protein kinases can phosphorylate a voltage-gated potassium channel protein and lead to the inability of the potassium channel to open during an action potential. The inability of the potassium channel to open results in a decrease in the outward flow of potassium, which normally repolarizes the membrane of a neuron, leading to prolonged membrane depolarization.

Cyclic AMP also influences cardiovascular physiology. For instance, cAMP activates protein kinase A (PKA). The activated subunits of PKA initiate a series of enzymatic reactions that ultimately activate multiple proteins that regulate both the rate and force of cardiac contraction. For instance, phosphorylation of the L-type calcium channel enhances calcium entry into cardiocytes leading to increased contractility. Upon phosphorylation of phospholamban, the inhibition exerted by the non phosphorylated form of phospholamban on the sarcoplasmic reticulum calcium pump is removed, and its rate of calcium uptake increased, thereby leading to a more rapid decrease of the cytosolic calcium concentration during diastole. Dissociation of the troponin C-calcium complex is also enhanced when troponin I is phosphorylated which leads to an accelerated relaxation rate. Such events result in the enhancement of cardiac output. This process rapidly reverses when agonist occupancy of the receptor ceases, i.e. the reuptake of norepinephrine into presynaptic stores. For a review, see for example, Yoshihiro et al. (1997) *Circulation Research* 80:297-304 and Castellano et al. (1997) *Hypertension* 29:715-722.

As the enzyme that catalyzes conversion of intracellular ATP to cAMP, adenylate cyclase plays a central role in the regulation of cellular cAMP concentrations. Disruption or modulation of adenylate cyclase activity affects intracellular concentrations of cAMP, which can in turn modulate the cAMP signal transduction pathway.

Many cardiovascular patho-physiological conditions result from modulations in the cAMP signaling pathway. Therefore, changes in concentration and function of receptors, G-proteins, and adenylate cyclase may thus constitute fundamental defects underlying certain cardiac diseases.

Alterations that accompany physiological changes in cardiovascular function include, for example, transformations of the myocardial structure and function such as a transition of the myosin heavy chain isoform (Imumo et al. (1987) *J Clin Invest* 79:970-977), accumulation of alpha-skeletal muscle actin mRNA (Schwartz et al. (1986) *Circ Res* 59:551-555) changes in troponin isoforms (Mayer et al. (1995) *Curr Opin Cardiol* 10:238-245) deterioration of Na+K+-ATPases (Charlemagne et al. (1986) *J Biol Chem* 261:185-189) and collagen remodeling of myocardium (Wever et al. (1988) *Circ Res* 62:757-763). Further changes in physiological cardiovascular function resulting from various forms of heart failure include alterations in arterial tone and reactivity and alterations in platelet function including aggregation, secretion, and clot formation and blood pressure elevation. (Marcil et al. (1996) *Hypertension* 28:83-90).

Adenylate cyclase has been implicated in many cardiovascular diseases. For example, adenylate cyclase activity and its responsiveness to various hormones is altered in hypertensive patients. Aberrant adenylate cyclase levels in hypertensive patients were restored toward normal following antihypertensive drug therapy (Marcil et al. (1996) *Hypertension* 28:83-90). In addition, studies of heart in human and animal models indicate adenylate cyclase has function in cardiomyopathy (Michael et al. (1995) *Hypertension* 25:962-970, Roth et al (1999) *Circulation* 99:3099-3099), ischemia (Sandhu et al. (1996) *Circulation Research* 78:137-147), myocardial infarction (Espinasse et al. (1999) *Cardiovascular Research* 42:87-98) and congestive heart failure (Kawahira et al. (1998) *Circulation* 98:262-267, Panza et al. (1995) *Circulation* 91:1732-1738). Additionally, studies have indicated that adenylate cyclase has function in clinical situations resulting in myocardial dysfunction such as cardiopulmonary bypass (Booth et al. (1998) *Anesthesiology* 89: 602-611). Decreased concentrations of adenylate cyclase also occur in chronic pacing-induced heart failure (Ishikawa et al. (1994) *J Clin Invest* 93:2224-9), whereas changes in activity of adenylate cyclase isoforms occur with activation of PKC (Kawabe et al. (1994) *J Biol Chem* 169: 16554-8), PKA (Chen et al. (1997) *PNAS* 94: 14100-4), aging and in pressure-overload failing right ventricles (Bristow et al. (1992) *J Clin Invest* 89:803-15).

As the enzyme that catalyzes conversion of intracellular ATP to cAMP, adenylate cyclase plays a central role in the regulation of cellular cAMP concentrations. Disruption or modulation of adenylate cyclase activity affects intracellular concentrations of cAMP, which can in turn modulate the cAMP signal transduction pathway. Modulation of this pathway can disrupt or alter cellular metabolism, growth, and differentiation, potentially leading to cellular growth related-disorders. As used herein, a "cellular growth-related disorder" includes a disorder, disease, or condition characterized by a deregulation, e.g., an upregulation or a downregulation, of cellular growth. Cellular growth deregulation may be due to a deregulation of cellular proliferation, cell cycle progression, cellular differentiation and/or cellular hypertrophy. Examples of cellular growth related disorders include cardiovascular disorders such as heart failure, hypertension, atrial fibrillation, dilated cardiomyopathy, idiopathic cardiomyopathy, or angina; proliferative disorders or differentiative disorders such as cancer, e.g., melanoma, prostate cancer, cervical cancer, breast cancer, colon cancer, or sarcoma. Disorders associated with the tissues in which 21529 is expressed are also encompassed, especially skeletal muscle, heart, aorta, cervix, vein, brain, pancreas, and fetal kidney. Other disorders include tumors of the breast, lung, and colon. Disorders that are particularly relevant with respect to expression of the adenylate cyclase are cardiovascular disorders. As described above, the 21529 adenylate cyclase is expressed in human cardiovascular tissues. Further, the 21529 gene is highly expressed in hypertrophic cardiac myocytes. Accordingly, disorders that are relevant include hypertension, atherosclerosis, ischemia, cardiomyopathy, congestive heart failure, myocardial infarction, and diseases of the cardiovascular system as disclosed herein.

The disclosed invention relates to methods and compositions for the modulation, diagnosis, and treatment of adenylate cyclase-associated or related disorders, particularly disorders resulting from aberrations in components of the cAMP signal transduction pathway, such as cAMP-dependent disorders, and disorders associated with cAMP-dependent protein kinases. Such disorders include, but are not limited to, disorders involving the skeletal muscle, heart, cervix, blood vessels, brain, pancreas, and cardiovascular system. Further relevant disorders include disorders involving the breast, and especially tumors of the breast.

Specifically, the present invention provides isolated nucleic acid molecules comprising nucleotide sequences encoding the 21529 adenylate cyclase polypeptide whose amino acid sequence is given in SEQ ID NO:47, or a variant or fragment of the polypeptide. A nucleotide sequence encoding an adenylate cyclase polypeptide of the invention, more particularly the polypeptide of SEQ ID NO:47, is set forth in SEQ ID NO:46 and 48.

A novel human gene, termed clone 21529 is provided. This sequence, and complements thereof, are referred to as "adenylate cyclase" sequences indicating that the gene sequences share sequence similarity to adenylate cyclase genes.

The novel 21529 adenylate cyclase gene encodes an approximately 3.52 Kb mRNA transcript having the corresponding cDNA set forth in SEQ ID NO:46. This transcript has a 3231 nucleotide open reading frame (nucleotides 247-3477 of SEQ ID NO:46; nucleotides 1-3231 of SEQ ID NO:48), which encodes a 1077 amino acid protein (SEQ ID NO:47). An analysis of the full-length 21529 polypeptide predicts that the N-terminal 50 amino acids may represent a region comprising a signal peptide. MEMSAT program analysis of the full-length 21529 polypeptide predicted transmembrane segments at amino acid residues (aa) 27-50, 61-79, 92-113, 120-136, 143-160, 174-190, 365-381, 408-424, 589-605, 612-631, 664-685, 713-736, 744-760, and 790-807 of SEQ ID NO:47. Transmembrane segments for the presumed mature peptide (aa 51-1077) were predicted at aa 11-29, 42-63, 70-86, 93-110, 124-140, 315-331, 358-374, 539-555, 562-581, 614-635, 663-686, 694-710, and 740-757 of SEQ ID NO:47. Prosite program analysis was used to predict various sites within the 21529 protein. N-glycosylation sites were predicted at aa 697-700, 704-707, 836-839, and 938-941 of SEQ ID NO:47, with the actual modified residue being the first amino acid. Protein kinase C phosphorylation sites were predicted at aa 6-8, 51-53, 202-204, 212-214, 218-220, 290-292, 526-528, 550-552, and 606-608 of SEQ ID NO:47, with the actual modified residue being the first amino acid. Casein kinase II phosphorylation sites were predicted at aa 51-54, 115-118, 202-205, 253-256, 290-293, 333-336, 359-362, 465-468, 495-498, 687-690, 878-881, 919-922, 941-944, 958-961, 968-971, and 1015-1018 of SEQ ID NO:47, with the actual modified residue being the first amino acid. Tyrosine kinase phosphorylation sites were predicted at aa 318-325, 437-444, 570-576, and 859-865 of SEQ ID NO:47, with the actual modified residue being the last amino acid. N-myristoylation sites were predicted at aa 35-40, 111-116, 137-142, 145-150, 184-189, 329-334, 345-350, 360-365, 368-373, 402-407, 412-417, 458-463, 654-659, 661-666, 936-941, 995-1000, 1008-1013, and 1055-1060 of SEQ ID NO:47, with the actual modified residue being the first amino acid. A prokaryotic membrane lipoprotein lipid attachment site was predicted at aa 745-755 of SEQ ID NO:47, and a leucine zipper pattern was predicted at aa 55-76 of SEQ ID NO:47. Guanylate cyclase signature sequences were predicted at aa 377-400 and 995-1018 of SEQ ID NO:47.

The 21529 adenylate cyclase protein possesses two adenylate/guanylate cyclase catalytic domains, from aa 264-448 and aa 864-1064 of SEQ ID NO:47, as predicted by HMMer, Version 2. Other domain matches predicted by HMMer included a copper/zinc superoxide dismutase domain, from aa 376-383 of SEQ ID NO:47, and a eubacterial secY protein domain, from aa 60-385 of SEQ ID NO:47.

The 21529 protein displays closest similarity to the rat adenylate cyclase IV (CYA4) (SP Accession Number P26770), approximately 86% identity over their 1075 amino acid overlap.

A plasmid containing the 21529 cDNA insert was deposited with the Patent Depository of the American Type Culture Collection (ATCC), 10801 University Boulevard, Manassas, Va., on Apr. 6, 2000, and assigned Patent Deposit Number PTA-1661. This deposit will be maintained under the terms of the Budapest Treaty on the International Recognition of the Deposit of Microorganisms for the Purposes of Patent Procedure. This deposit was made merely as a convenience for those of skill in the art and is not an admission that a deposit is required under 35 U.S.C. §112.

The 21529 adenylate cyclase sequences of the invention are members of a family of molecules having conserved functional features. The term "family" when referring to the proteins and nucleic acid molecules of the invention is intended to mean two or more proteins or nucleic acid molecules having sufficient amino acid or nucleotide sequence identity as defined herein. Such family members can be naturally occurring and can be from either the same or different species. For example, a family can contain a first protein of murine origin and a homolog of that protein of human origin, as well as a second, distinct protein of human origin and a murine homolog of that protein. Members of a family may also have common functional characteristics.

Another embodiment of the invention features isolated adenylate cyclase proteins and polypeptides having an adenylate cyclase protein activity. As used interchangeably herein, a "adenylate cyclase protein activity", "biological activity of an adenylate cyclase protein", or "functional activity of an adenylate cyclase protein" refers to an activity exerted by an adenylate cyclase protein, polypeptide, or nucleic acid molecule on an adenylate cyclase responsive cell as determined in vivo, or in vitro, according to standard assay techniques. An adenylate cyclase activity can be a direct activity, such as conversion of intracellular ATP to cAMP, or an indirect activity, such as a cellular activity mediated by generation of cAMP, such as any downstream cellular response associated with the cAMP signal transduction pathway. In a preferred embodiment, a 21529 adenylate cyclase activity includes at least one or more of the following activities: (1) modulating (stimulating and/or enhancing or inhibiting) cellular growth, differentiation, and/or function, particularly in cells in which the sequences are expressed, for example, cells of the skeletal muscle, heart, cervix, vein, brain, pancreas, fetal kidney, and breast tumors, and cardiovascular tissue; a protein kinase A cellular effect, such as release of hormones, glycogen metabolism, such as in liver, heart, and skeletal muscles; (2) modulating the cAMP signal transduction pathway; (3) modulating a target cell's cAMP concentration; (4) modulating cAMP-dependent protein kinase activity, such as protein kinase A; and (5) modulating the release of hormones, such as release of cortisol in the adrenal gland cells, thyroid hormones from the thyroid gland, testosterone from testicular Leydig cells, and melatonin from the pineal gland.

Isolation of 21529

Clone 21529 was isolated from a human spleen or heart cDNA library. The identified clone 21529 encodes a transcript of approximately 3.52 Kb (corresponding cDNA set forth in SEQ ID NO:46). The open reading frame (nucleotides 247-3477 of SEQ ID NO:46; nucleotides 1-3231 of SEQ ID NO:48) of this transcript encodes a predicted 1077 amino acid protein (SEQ ID NO:47). This novel gene is preliminarily mapped to human chromosome 14 using the mapping panel Genebridge 4 human RH.

A search of the nucleotide and protein databases revealed that 21529 encodes a polypeptide that shares similarity with several adenylate cyclases, the greatest similarity being seen with the rat adenylate cyclase type IV protein (SP Accession Number P26770). An alignment of the 21529 polypeptide with this rat protein, using the Clustal method with PAM250 residue weight table, demonstrates the overall close similarity between the two sequences and indicates that 21529 is the human ortholog of the rat adenylate cyclase type IV.

mRNA Expression of Clone 21529

Expression of the novel 21529 adenylate cyclase was measured by TaqMan® quantitative PCR (Perkin Elmer Applied Biosystems) in cDNA prepared from the following normal human tissues: thymus, skeletal muscle, liver, lung, thyroid, heart, ovary, aorta, placenta, cervix, lymph node, vein, brain, esophagus, pancreas, kidney, brain, prostate, liver, spleen, breast, colon, tonsil, small intestine, fetal kidney, fetal liver, fetal heart, and testis.

Probes were designed by PrimerExpress software (PE Biosystems) based on the 21529 sequence. The primers and probes for expression analysis of 21529 and β-2 microglobulin were as follows:

| | |
|---|---|
| 21529 Forward Primer | AGCTGTGGCCCAGTTAATGG |
| 21529 Reverse Primer | CTTTGGCCCCTTCCAGGTT |
| 21529 TaqMan Probe | CTACCGACTGGCGGTCATTGCCAG |
| β-2 microglobulin Forward Primer | CACCCCCACTGAAAAAGATGA |
| β-2 microglobulin Reverse Primer | CTTAACTATCTTGGGCTGTGACAAAG |
| β-2 microglobulin TaqMan Probe | TATGCCTGCCGTGTGAACCACGTG |

The 21529 sequence probe was labeled using FAM (6-carboxyfluorescein), and the β2-microglobulin reference probe was labeled with a different fluorescent dye, VIC. The differential labeling of the target adenylate cyclase sequence and internal reference gene thus enabled measurement in the same well. Forward and reverse primers and the probes for both β2-microglobulin and the target 21529 sequence were added to the TaqMan® Universal PCR Master Mix (PE Applied Biosystems). Although the final concentration of primer and probe could vary, each was internally consistent within a given experiment. A typical experiment contained 200 nM of forward and reverse primers plus 100 nM probe for β-2 microglobulin and 600 nM forward and reverse primers plus 200 nM probe for the target 21529 sequence. TaqMan matrix experiments were carried out on an ABI PRISM 7700 Sequence Detection System (PE Applied Biosystems). The thermal cycler conditions were as follows: hold for 2 min at 50° C. and 10 min at 95° C., followed by two-step PCR for 40 cycles of 95° C. for 15 sec followed by 60° C. for 1 min.

The following method was used to quantitatively calculate 21529 expression in the various tissues relative to β-2 microglobulin expression in the same tissue. The threshold cycle (Ct) value is defined as the cycle at which a statistically significant increase in fluorescence is detected. A lower Ct value is indicative of a higher mRNA concentration. The Ct value of the 21529 sequence is normalized by subtracting the Ct value of the β-2 microglobulin gene to obtain a $_\Delta Ct$ value using the following formula: $_\Delta Ct = Ct_{h21529} - Ct_{\beta\text{-}2\,microglobulin}$. Expression is then calibrated against a cDNA sample showing a comparatively low level of expression of the 21529 sequence. The $_\Delta Ct$ value for the calibrator sample is then subtracted from $_\Delta Ct$ for each tissue sample according to the following formula: $_{\Delta\Delta}Ct = _\Delta Ct_{sample} - _\Delta Ct_{calibrator}$. Relative expression is then calculated using the arithmetic formula given by $2^{-\Delta\Delta Ct}$. Expression of the target 21529 sequence in each of the tissues tested was then analyzed as discussed in more detail below.

The mRNA for the putative adenylate cyclase 21529 is differentially expressed in all of the normal tissues tested. There was significant expression in pancreas, vein, brain, heart, and skeletal muscle; moderate expression in cervix, fetal kidney, fetal heart, liver, placenta, thyroid, ovary, breast, aorta, and brain; and lower expression in lymph node, esophagus, kidney, lung, spleen, testis, small intestine, fetal liver, colon, prostate, thymus, and tonsil. These data indicate this novel adenylate cyclase has a widely dispersed pattern of expression, a characteristic in common with the rat adenylate cyclase IV homolog.

TaqMan data obtained using an Oncology panel wherein normal breast, normal lung, normal colon and normal liver tissue samples were compared to breast tumor, lung tumor, colon tumor and liver tumor samples, respectively, demonstrated that 21529 was upregulated in breast and colon tumor samples compared to their respective normal tissue samples.

mRNA Expression of Clone 21529 in Human Cardiovascular Tissues mRNA was hybridized as discussed above in the following cardiovascular tissues: aorta, aorta with intimal proliferation, coronary artery, mammary internal artery, heart, congestive heart failure heart samples, ischemic heart samples, myopathic heart samples, and saphenous vein. These were compared in terms of relative expression to the expression of the gene in skeletal muscle. Highest expression was observed in tissue from congestive heart failure patients and myopathic hearts. Significant expression was also observed in coronary artery and in the internal mammary artery. Further, significant expression was also observed in ischemic heart. Lower levels of expression were observed in the remainder of the tissues.

Further, in situ hybridization experiments were done against hypertrophic cardiac myocytes from diseased hearts. Results showed increased expression of the gene in the hypertrophic myocytes.

Human 26176

The present invention is based, at least in part, on the discovery of a novel calpain protease referred to herein as "26176". The present invention provides isolated nucleic acid molecules comprising nucleotide sequences encoding the 26176 calpain protease polypeptide whose amino acid sequence is given in SEQ ID NO:50, or a variant or fragment of the polypeptide. A nucleotide sequence encoding the 26176 calpain protease polypeptides of the invention is set forth in SEQ ID NO:49. The sequences are members of the calpain family of thiol proteases, also referred to as the peptidase family C2.

Calpains refer to calcium-activated neutral proteinases, a superfamily of endopeptidases typically having cysteine-proteinase and calcium-binding characteristics. These proteinases cleave numerous substrate proteins in a limited manner, typically leading to modification of the function and/or activity rather than general degradation of the substrate.

Calpains are classified into two main groups, the typical or conventional calpains and the atypical calpains, based on their domain content and/or variation. The typical calpains are further subdivided into ubiquitous and tissue-specific calpains based on their predominate patterns of expression.

Two forms of ubiquitous calpains have been extensively characterized in vertebrates: the μ-calpains (calpain I, CAPN1) and the m-calpains (calpain II, CAPN2), which are activated in vitro by micro- and millimolar calcium concentrations, respectively. An intermediate μ/m calpain has been characterized in chicken.

The ubiquitous μ- and m-calpains are heterodimers, each having a distinct, but homologous, large 80 kDa subunit (referred to as μCL or mCL, respectively) and an identical small 30 kDa subunit (referred to as 30K or Cs). The large subunit has four domains, designated I-IV from the N-terminus to the C-terminus. The function of domain I is unclear. Domain II is the cysteine protease domain responsible for calpain protease activity. Domain III is homologous to a calmodulin-binding protein and is speculated to interact with the calcium-binding domains of the large (domain IV) and small subunits (domain VI), when calcium is bound, thereby freeing the protease domain for activity (Goll et al. (1992) *BioEssays* 14:549-556). Domain IV of the large subunit is a calmodulin-like calcium-binding domain containing four EF-hand calcium-binding motifs. Although structurally similar to calmodulin, domain IV is more similar to sorcin, ALG-2, and grancalcin. Sorcin is involved in the multi-drug resistance of cultured cell lines and was recently reported to associate with the cardiac ryanodine receptor. Grancalcin possibly plays a role in granule-membrane fusion and degranulation. ALG-2 is thought to be involved in apoptosis and is induced by tumor promoters. See Meyers et al. (1995) *J. Biol. Chem.* 270:26411-26418; Meyers et al. (1985) *J. Cell Biol.* 100:588-597; Vito et al. (1996) *Science* 271:521-525; Teahan et al. (1992) *Biochem. J.* 286:549-554; Boyhan et al. (1992) *J. Biol. Chem.* 267:2928-2933.

The small subunit of typical calpains contains two domains, which are designated V and VI from the N-terminus to the C-terminus. Domain V is an N-terminal glycine-clustering hydrophobic region. Domain VI, which is similar to domain IV of the large subunit, is also a calcium-binding domain containing six EF-hands, EF2-EF5 as in the large subunit, and EF1 and EF6. EF5 of domain VI does not bind calcium and is proposed to be involved in the heterodimeric binding of domains IV and VI during interaction between the large and small subunits.

Calpastatin is an endogenous inhibitor of most calpains, the tissue-specific calpain p94 being an exception. Calpastatin, which has five domains, is cleaved by calpain in the interdomain regions, generating inhibitory peptides. The inhibitory effect of calpastatin has been attributed to interactions with calpain domains II, III, IV, and VI. The reactive site of calpastatin shows no apparent homology to that of other protease inhibitors, and it contains the consensus sequence TIPPXYR (SEQ ID NO:52), which is essential for inhibition. See Kawasaki et al. (1989) *J. Biochem.* 106:274-281; Croall et al. (1994) *Biochem.* 33:13223-13230; Croall et al. (1991) *Physiol. Rev.* 71:813-847; Kawasaki et al. (1996) *Mol. Membr. Biol.* 13:217-224; Melloni et al. (1989) *Trends Neurosci.* 12:438-444; Sorimachi et al. (1997) *J. Biochem.* 328: 721-732; and Johnson et al. (1997) *BioEssays* 19(11): 1011-1018.

Several typical tissue-specific calpains are known in vertebrates, including skeletal muscle p94 (nCL-1, calpain 3', CAPN3), stomach nCL2 (CAPN4) and nCL 2', and digestive tubule nCL4. While p94 contains EF hands, it does not require calcium for proteinase activity. p94 has a domain IV sequence similar to that of μCL and mCL, but it does not bind to a small 30 kDa subunit (Kinbara et al. (1997) *Arch. Biochem. Biophys.* 342:99-107). p94 contains unique insertion sequences called IS1 and IS2, which are found in domain II and between domains III and IV, respectively). IS2 contains a nuclear-localization-signal-like basic sequence (Arg-Pro-Xaa-Lys-Lys-Lys-Lys-Xaa-Lys-Pro (SEQ ID NO:53)). Connectin/titin binding is also attributed to IS2. p94 may change its localization in a cell-cycle dependent manner and may be involved in muscle differentiation by interacting with the MyoD family. In fact, a defect in the protease p94 is responsible for limb-girdle muscular dystrophy type 2A (LGMD2A). See Sorimachi et al. (1995) *J. Biol. Chem.* 270:31158-31162; Sorimachi et al. (1993) *J. Biol. Chem.* 268:10593-10605; Gregoriou et al. (1994) *Eur. J. Biochem.* 223:455-464; and Belcastro et al. (1998) *Mol. Cell. Biochem.* 179 (1, 2):135-145.

Calpains have broad physiological and pathological roles related to the enzymes' diverse population of substrates. Calpain substrates include "PEST" proteins, which have high proline, glutamine, serine, and threonine contents; calpain and calpastatin; signal transduction proteins including protein kinase C, transcription factors c-Jun, c-Fos, and α-subunit of heterotrimeric G proteins; proteins involved in cell proliferation and cancer including P53 tumor suppressor, growth factor receptors (eg., epidermal growth factor receptor), c-Jun, c-Fos, and N-myc; proteins with established physiological roles in muscle including $Ca^{++}$-ATPase, Band III, troponin, tropomyosin, and myosin light chain kinase; myotonin protein kinase; proteins with established physiological roles in the brain and the central nervous system including myelin proteins, myelin basic protein (MBP), axonal neurofilament protein (NFP), myelin protein MAG; cytosketetal and cell adhesion proteins including troponins, talin, neurofilaments, spectrin, microtubule associated protein MAP-2, tau, MAPIB, fodrin, desmin, α-actinin, vimentin, spectrin, integrin, cadherin, filamin, and N-CAM; enzymes including protein kinases A and C, and phospholipase C; and histones.

See Sorimachi et al. (1997) *J. Biochem.* 328:721-732; Johnson et al. (1997) *BioEssays* 19(11):1011-1018; Shields et al. (1999) *J. Neuroscience Res.* 55(5):533-541; and Belcastro et al. (1998) *Mol. Cell. Biochem.* 179 (1, 2):135-145.

Calpain is implicated in a wide variety of physiological processes including alteration of membrane morphology, long-term potentiation of memory, axonal regeneration, neurite extension, cell proliferation (division), gastric HCl secretion, embryonic development, secretory granule movement, cell differentiation and regulation, cytoskeletal and membrane changes during cell migration, cytoskeletal remodeling, sex determination, and alkaline adaptation in fungi. See Solary et al. (1998) *Cell Biol. Toxicol.* 14:121-132; Sorimachi et al. (1997) *J. Biochem.* 328:721-732; Johnson et al. (1997) *BioEssays* 19(11):1011-1018; Suzuki et al. (1998) *FEBS Letters* 433(1, 2):1-4; Franz et al. (1999) *Mammalian Genome* 10(3):318-321; Shields et al. (1999) *J. Neuroscience Res.* 55(5):533-541; Schnellmann et al. (1998) *Renal Failure* 20(5):679-686; Banik et al. (1998) *Annals New York Acad. Sc.* 844:131-137; Belcastro et al. (1998) *Mol. Cell. Biochem.* 179 (1, 2):135-145; and McIntosh et al. (1998) *J. Neurotrauma* 15(10):731-769.

Under pathological conditions, aberrant regulation and/or activity of calpain can be detrimental to cells and tissues. In this context, calpains are implicated in a wide variety of disease states including exercise-induced injury and repair; apoptosis including T cell receptor-induced apoptosis, HIV-infected cell apoptosis, ectoposide-treated cell apoptosis, nerve growth factor deprived neuronal apoptosis; ischemia, such as cerebral and myocardial ischemia; traumatic brain injury; Alzheimer's disease and other neurodegenerative diseases; demyelinating diseases including experimental allergic encephalomyelitis (EAE) and multiple sclerosis; LGMD2A muscular dystrophy; spinal cord injury (SCI); cancer; cataract formation; and renal cell death by diverse toxicants.

The disclosed invention relates to methods and compositions for the modulation, diagnosis, and treatment of calpain protease-mediated disorders. Such disorders include, but are not limited to, disorders associated with perturbed cellular growth and differentiation; exercise-induced injury and repair; apoptosis including T-cell receptor-induced apoptosis, HIV-infected cell apoptosis, ectoposide-treated cell apoptosis, nerve growth factor deprived neuronal apoptosis; ischemia; traumatic brain injury; Alzheimer's disease and other neurodegenerative diseases; demyelinating diseases including experimental allergic encephalomyelitis (EAE) and multiple sclerosis; LGMD2A muscular dystrophy; spinal cord injury (SCI); proliferative disorders or differentiative disorders such as cancer, e.g., melanoma, prostate cancer, cervical cancer, breast cancer, colon cancer, or sarcoma; and renal cell death associated with diverse toxicants.

The sequences of the invention find use in diagnosis of disorders involving an increase or decrease in protease expression relative to normal expression, such as a proliferative disorder, a differentiative disorder, or a developmental disorder. The sequences also find use in modulating protease-related responses. By "modulating" is intended the upregulating or downregulating of a response. That is, the compositions of the invention affect the targeted activity in either a positive or negative fashion.

One embodiment of the invention features protease nucleic acid molecules, preferably human protease molecules, which were identified based on a consensus motif or protein domain characteristic of the calpain family of thiol proteases. Specifically, a novel human gene, termed clone 26176, is provided. This sequence, and other nucleotide sequences encoding the 26176 protein or fragments and variants thereof, are referred to as "calpain protease sequences" indicating that the sequences share sequence similarity to other calpain protease genes.

The calpain protease gene designated clone 26176 was identified in a human T-cell cDNA library. Clone 26176 encodes an approximately 3.78 Kb mRNA transcript having the corresponding cDNA set forth in SEQ ID NO:49. This transcript has a 2439 nucleotide open reading frame (nucleotides 276-2714 of SEQ ID NO:49; nucleotides 1-2439 of SEQ ID NO:51), which encodes an 813 amino acid protein (SEQ ID NO:50). MEMSAT analysis of the full-length 26176 polypeptide predicts a transmembrane segment from amino acids (aa) 286-302 of SEQ ID NO:50. Prosite program analysis was used to predict various sites within the 26176 protein. An N-glycosylation site was predicted at aa 366-369 of SEQ ID NO:50 with the actual residue being the first residue. A cAMP- and cGMP-dependent protein kinase phosphorylation site was predicted at aa 759-762 of SEQ ID NO:50 with the actual phosphorylated residue being the last residue. Protein kinase C phosphorylation sites were predicted at aa 165-167, 215-217, 251-253, 281-283, 422-424, 594-596, 668-670, 689-691, and 710-712 of SEQ ID NO:50 with the actual phosphorylated residue being the first residue. Casein kinase II phosphorylation sites were predicted at aa 4-7, 48-51, 123-126, 205-208, 373-376, 393-396, 445-448, 490-493, 523-526, 551-554, 594-597, 657-660, 748-751, and 761-764 of SEQ ID NO:50 with the actual phosphorylated residue being the first residue. Tyrosine kinase phosphorylation sites were predicted at aa 20-26 and aa 320-326 of SEQ ID NO:50 with the actual phosphorylated residue being the last. N-myristoylation sites were predicted at aa 201-206, 390-395, 453-458, 630-635, and 698-703 of SEQ ID NO:50 with the actual modified residue being the first. An amidation site was predicted at aa 614-617 of SEQ ID NO:50. The calpain protease protein 26176 possesses a calpain family cysteine protease domain (domain II), from aa 231-537 of SEQ ID NO:50, and a calpain large subunit domain III, from aa 685-810 of SEQ ID NO:50, as predicted by HMMer, Version 2.

The protein displays the closest similarity to the human gene designated PalBH, (Accession Numbers GPU:gi [5102944] dbj [BAA78730] (AB028639).

The 26176 protein also displays similarity to the murine CAPN7 protein, approximately 93% identity and 95% overall similarity over a 768 amino acid overlap (amino acid residues 45-813 of the 26176 protein (SEQ ID NO:50)), indicating 26176 is the human ortholog of this murine protein.

A plasmid containing the 26176 cDNA insert was deposited with the Patent Depository of the American Type Culture Collection (ATCC), 10801 University Boulevard, Manassas, Va., on Apr. 6, 2000, and assigned Patent Deposit Number PTA-1649. This deposit will be maintained under the terms of the Budapest Treaty on the International Recognition of the Deposit of Microorganisms for the Purposes of Patent Procedure. This deposit was made merely as a convenience for those of skill in the art and is not an admission that a deposit is required under 35 U.S.C. 112.

The calpain protease sequences of the invention are members of a protease family of molecules having conserved functional features. The term "family" when referring to the proteins and nucleic acid molecules of the invention is intended to mean two or more proteins or nucleic acid molecules having sufficient amino acid or nucleotide sequence identity as defined herein. Such family members can be naturally occurring and can be from either the same or different species. For example, a family can contain a first protein of murine origin and an ortholog of that protein of human origin, as well as a second, distinct protein of human origin and a murine ortholog of that protein. Members of a family may also have common functional characteristics.

Preferred 26176 calpain protease polypeptides of the present invention have an amino acid sequence sufficiently identical to the amino acid sequence of SEQ ID NO:50. The term "sufficiently identical" is used herein to refer to a first amino acid or nucleotide sequence that contains a sufficient or minimum number of identical or equivalent (e.g., with a similar side chain) amino acid residues or nucleotides to a second amino acid or nucleotide sequence such that the first and second amino acid or nucleotide sequences have a common structural domain and/or common functional activity. For example, amino acid or nucleotide sequences that contain a common structural domain having at least about 45%, 55%, or 65% identity, preferably 75% identity, more preferably 85%, 95%, or 98% identity are defined herein as sufficiently identical.

Another embodiment of the invention features isolated calpain protease proteins and polypeptides having a calpain protease protein activity. As used interchangeably herein, a "calpain protease protein activity", "biological activity of a calpain protease protein", or "functional activity of a calpain protease protein" refers to an activity exerted by a calpain protease protein, polypeptide, or nucleic acid molecule on a calpain-protease-responsive cell as determined in vivo, or in vitro, according to standard assay techniques. A calpain protease activity can be a direct activity, such as an association with or an enzymatic activity on a second protein, or an indirect activity, such as a cellular signaling activity mediated by interaction of the calpain protease protein with a second protein. In a preferred embodiment, a 26176 calpain protease activity includes at least one or more of the following activities: (1) modulating (stimulating and/or enhancing or inhibiting) cellular proliferation, differentiation, and/or function (e.g., in cells in which it is expressed, for example, cells within normal and carcinoma tissues, such as lung, liver, colon, and breast; brain and skeletal muscle cells, etc.); (2) modulating a calpain protease response; (3) modulating the entry of cells into mitosis; (4) modulating cellular differentiation; and (5) modulating cell death.

Isolation of 26176

Clone 26176 was isolated from a human T-cell cDNA library. The identified clone 26176 encodes a transcript of approximately 3.78 Kb (corresponding cDNA set forth in SEQ ID NO:49). The open reading frame (nucleotides 276-2714 of SEQ ID NO:49; nucleotides 1-2439 of SEQ ID NO:51) of this transcript encodes a predicted 813 amino acid protein (SEQ ID NO:50)

A search of the nucleotide and protein databases revealed that 26176 encodes a polypeptide that shares similarity with several calpain proteases, the greatest similarity being seen with the murine CAPN7 protein (EMB Accession Number AJ012475).

mRNA Expression of Clone 26176

Expression of the novel 26176 calpain protease was measured by TaqMan® quantitative PCR (Perkin Elmer Applied Biosystems) in cDNA prepared from the following human tissues: normal colon, colon carcinoma, normal liver, colon metastasis, normal lung, lung carcinoma, normal breast, and breast carcinoma.

Probes were designed by PrimerExpress software (PE Biosystems) based on the 26176 sequence. The primers and probes for expression analysis of 26176 and β-2 microglobulin were as follows:

| | |
|---|---|
| 26176 Forward Primer | AATAGTATCGGATTGCTCCTTTGTG |
| 26176 Reverse Primer | GCCGGTAATTAACTTCTTATTAAAACG |
| 26176 TaqMan Probe | CATCACTGGCCATCAGTGCAGCTTATG |
| β-2 microglobulin Forward Primer | CACCCCCACTGAAAAGATGA |
| β-2 microglobulin Reverse Primer | CTTAACTATCTTGGGCTGTGACAAAG |
| β-2 microglobulin TaqMan Probe | TATGCCTGCCGTGTGAACCACGTG |

The 26176 sequence probe was labeled using FAM (6-carboxyfluorescein), and the β2-microglobulin reference probe was labeled with a different fluorescent dye, VIC. The differential labeling of the target calpain protease sequence and internal reference gene thus enabled measurement in the same well. Forward and reverse primers and the probes for both β2-microglobulin and the target 26176 sequence were added to the TaqMan® Universal PCR Master Mix (PE Applied Biosystems). Although the final concentration of primer and probe could vary, each was internally consistent within a given experiment. A typical experiment contained 200 nM of forward and reverse primers plus 100 nM probe for β-2 microglobulin and 600 nM forward and reverse primers plus 200 nM probe for the target 26176 sequence. TaqMan matrix experiments were carried out on an ABI PRISM 7700 Sequence Detection System (PE Applied Biosystems). The thermal cycler conditions were as follows: hold for 2 min at 50° C. and 10 min at 95° C., followed by two-step PCR for 40 cycles of 95° C. for 15 sec followed by 60° C. for 1 min.

The following method was used to quantitatively calculate 26176 expression in the various tissues relative to β-2 microglobulin expression in the same tissue. The threshold cycle (Ct) value is defined as the cycle at which a statistically significant increase in fluorescence is detected. A lower Ct value is indicative of a higher mRNA concentration. The Ct value of the 26176 sequence is normalized by subtracting the Ct value of the β-2 microglobulin gene to obtain a $_\Delta Ct$ value using the following formula: $_\Delta Ct = Ct_{h26176} - Ct_{\beta-2}$ microglobulin. Expression is then calibrated against a cDNA sample showing a comparatively low level of expression of the 26176 sequence. The $_\Delta Ct$ value for the calibrator sample is then subtracted from $_\Delta Ct$ for each tissue sample according to the following formula: $_{\Delta\Delta}Ct = {_\Delta Ct}_{sample} - {_\Delta Ct}_{calibrator}$. Relative expression is then calculated using the arithmetic formula given by $2^{-\Delta\Delta Ct}$. Expression of the target 26176 sequence in each of the tissues tested was then analysed.

The mRNA for the putative calpain protease 26176 is expressed in a variety of tumors. There was significant upregulation in colon carcinoma and breast carcinoma. Accordingly, expression of the 26176 calpain protease is relevant to colon and breast carcinoma. In additional experiments, the gene was expressed in three out of four normal lung tissue samples but in 15 out of 16 lung carcinoma clinical samples. Accordingly, expression of the 26176 calpain protease is relevant to lung carcinoma as well. This is consistent with the hypothesis that proteases may function in carcinogenesis by inactivating or activating regulators of cell cycle, differentiation, apoptosis, or other processes affecting cancer development and/or progression. In view of the fact that the 26176 gene is up-regulated in colon carcinoma, the gene is useful for inhibiting tumor progression. Inhibition of expression of this 26176 protease can thus be used to decrease the progression of carcinogenesis.

In addition, Northern blot experiments showed expression of the 26176 calpain protease in bone, ovary, T-cell, spleen, and kidney tissue. Accordingly, the 26176 protease is relevant to disorders involving these tissues.

In addition, 26176 expression has been observed in heart, neuronal tissue, monocytes, and prostate. Accordingly, expression of the 26176 gene is relevant to disorders involving these tissues.

Finally, 26176 expression has been observed in parathyroid tumor and in thymus. Accordingly, detection of expression or modulation of expression of the 26176 gene in these tissues, and particularly in disorders involving these tissues, is relevant.

Human 26343

The present invention is based, at least in part, on the discovery of novel molecules, referred to herein "Oxidoreductase Protein", "OP" or "26343" nucleic acid and protein molecules, which are novel members of a family of enzymes possessing oxidoreductase activity. These novel molecules are capable of oxidizing and/or reducing molecular groups by catalyzing the transfer of a hydride moiety and, thus, play a role in or function in a variety of cellular processes, e.g., proliferation, metabolism, differentiation, hormonal responses, and inter- or intra-cellular communication.

The oxidation and reduction of molecules is of critical importance in many cellular metabolic and catabolic pathways. "Redox" reactions play important roles in the production and breakdown of nearly all major metabolic intermediates, including amino acids, vitamins, energy molecules (e.g., glucose, sucrose, and their breakdown products), signal molecules (e.g., transcription factors and neurotransmitters), and nucleic acids. A large class of enzymes which facilitate some of these molecular alterations, termed oxidoreductases, have been identified. In the forward reaction, these enzymes catalyze the transfer of a hydride ion from the target substrate to the enzyme or a cofactor of the enzyme (e.g., $NAD^+$, $NADP^+$, $FAD^+$), thereby oxidizing the substrate. These enzymes may also participate in the reverse reaction, wherein a molecular group of the target molecule is reduced by the transfer of a hydride group from the enzyme. Members of the oxidoreductases family are found in nearly all organisms, from prokaryotes to *Drosophila* to humans. Both between species and within the same species, oxidoreductases vary widely; disparate family members are frequently classified by the cofactor used by the enzyme (e.g., $NAD^+$, $NADP^+$, $FAD^+$), or by the particular substrate(s) of the enzyme (see, for example, Cavener, D. R. (1992) *J. Mol. Biol.* 223:811-814).

Different oxidoreductases are specific for a wide array of biological and chemical substrates. For example, there exist oxidoreductases specific for steroids (Kass and Sampson (1998) *Biochemistry* 37:17990-800), neurotransmitters (Lamark et al. (1991) *Mol. Microbiol.* 5:1049-1064), energy metabolites (Krasney et al. (1990) *Mol. Biol. Evol.* 7:155-177; Frederick), alcohols (Ledeboer et al. (1985) *Nucleic Acids Res.* 13:3069-3082; Koutz et al. (1989) *Yeast* 5:167-177), lipids (Funk et al. (1992) *Proc. Natl. Acad. Sci. USA* 89:3962-3966), amino acid precursors and nucleotide precursors (Wright et al. (1993) *Proc. Natl. Acad. Sci. USA* 90:10690-10694). Accordingly, oxidoreductase activity contributes to the ability of the cell to grow and differentiate, to proliferate, and to communicate and interact with other cells. Therefore, a wide range of metabolic disorders and related pathogenic states relate to the oxidoreductases, both directly and indirectly (see, for example, Salazar et al. (1997) *J. Biol. Chem.* 272:26425-26433).

As used herein, the term "oxidoreductase" includes a molecule which is involved in the oxidation or reduction of a biochemical molecule (e.g., a metabolic precursor which contains a molecular group which can be oxidized or reduced) by catalyzing the transfer of a hydride ion to or from the biochemical molecule. Oxidoreductase molecules are involved in the metabolism and catabolism of biochemical molecules necessary for energy production or storage, for intra- or inter-cellular signaling, and for metabolism or catabolism of metabolically important biomolecules. Examples of oxidoreductases include glucose oxidases, methanol oxidases, choline dehydrogenases, glucose dehydrogenases, cholesterol oxidases, alcohol dehydrogenases, and cellobiose dehydrogenases.

The OP proteins of the present invention show homology to the choline dehydrogenase family of oxidoreductases. Choline dehydrogenase (CDH) is the first enzyme of the glycine betaine synthetic pathway. Betaine, an atypical amino acid that is non-proteinogenic yet important as an osmoprotectant, is synthesized by a two-step oxidation of choline. This reaction takes place in the mitochondrial matrix by the membrane bound CDH and betaine aldehyde dehydrogenase (Landfald and Strom (1986) *J. Bacteriol.* 165:849-55; Styrvold et al. (1986) *J. Bacteriol.* 165:856-63; Grossman and Hebert (1989) *Am. J. Physiol.* 256(1 Pt. 2):F107-12; Zhang et al. (1992) *Biochim. Biophys. Acta.* 1117:333-9). CDH is also coupled to the respiratory chain. Betaine is further important in mammalian organisms as a major methyl group donor and nitrogen source.

Methyl groups derived from betaine may be used for recycling homocysteine to methionine. It is known that some tumor cells have an increased need for methionine for survival. Methionine dependent tumor cells are unable to proliferate, and they arrest in the G2 phase of the cell cycle. For example, MCF-7 breast cancer cells grown in methyl-deficient media show inhibition of cell proliferation and induction of apoptosis. Fresh patient colon tumors have also been shown to be methionine dependent based on cell cycle analyses. Metastatic colon tumors have a higher methionine dependence than primary tumors. Other examples of methionine dependence in tumors have been seen in small cell lung cancer and gliomas.

Human 26343 is overexpressed in various tumors, e.g., colon tumors, as compared to normal tissues (see section below on expression levels). Human 26343 is further elevated in later stage tumors. Elevation of the levels of the 26343 molecules of the present invention in tumor cells may increase tumor survival by increasing the supply of methionine available to the tumor cells. Accordingly, inhibition of the 26343 molecules of the present invention may cause tumor cell growth arrest and/or apoptosis, making the 26343 molecules of the present invention useful for the treatment of cellular proliferation, growth, apoptosis, differentiation, and/or migration disorders.

The 26343 molecules of the present invention may also be useful for the treatment of disorders characterized by the aberrant or abnormal regulation of the levels of choline, betaine (e.g., a disorder associated with aberrant regulation of osmolarity by betaine), homocysteine (e.g., homocystinuria), and/or methionine in a subject.

The 26343 molecules of the present invention may still further be useful for the treatment of disorders affecting tissues in which 26343 protein is expressed, e.g., primary osteoblasts, pituitary, CaCO cells, keratinocytes, aortic endothelial cells, fetal kidney, fetal lung, mammary epithelium, fetal spleen, fetal liver, umbilical smooth muscle, RAII Burkitt Lymphoma cells, lung, prostate, K53 red blood cells, fetal dorsal spinal cord, insulinoma cells, normal breast and ovarian epithelia, retina, HMC-1 mast cells, ovarian ascites, d8 dendritic cells, megakaryocytes, human mobilized bone morrow, mammary carcinoma, melanoma cells, lymph, vein, U937/A70p B cells, A549con cells, WT LN Cap testosterone cells, esophagus, and other tissues and/or cell types described further below.

In an alternate embodiment, any and all of the above described disorders may simply be referred to as "OP associated or related disorders".

For example, the family of OP proteins comprise at least one, and preferably three or more "transmembrane domains." As used herein, the term "transmembrane domain" includes an amino acid sequence of about 15 amino acid residues in length which spans the plasma membrane. More preferably, a transmembrane domain includes about at least 10, 15, 20, 25, 30, 35, 40, 45 or more amino acid residues and spans the plasma membrane. Transmembrane domains are rich in hydrophobic residues, and typically have a helical structure. In one embodiment, at least 50%, 60%, 70%, 80%, 90%, 95% or more of the amino acid residues of a transmembrane domain are hydrophobic, e.g., leucines, isoleucines, tyrosines, or tryptophans. Transmembrane domains are described in, for example, Zagotta W. N. et al. (1996) *Annu. Rev. Neurosci.* 19:235-63, the contents of which are incorporated herein by reference. Amino acid residues 41-57, 292-311, and 545-564 of the human 26343 polypeptide (SEQ ID NO:55) comprise transmembrane domains.

In another embodiment, an OP molecule of the present invention is identified based on the presence of an GMC oxidoreductase signature domain in the protein or corresponding nucleic acid molecule. As used herein, the term GMC oxidoreductase signature domain includes a protein domain having an amino acid sequence of about 375-650, more preferably about 450-600 amino acid residues, or most preferably about 500-550 amino acids and has a bit score for the alignment of the sequence to the GMC oxidoreductase signature domain (HMM) of at least about 100, 200, 300, 400, 500, 600, 700, 800, or more. Preferably, a GMC oxidoreductase signature domain includes at least about 526 amino acid residues and has a bit score for the alignment of the sequence to the GMC oxidoreductase signature domain (HMM) of about 767.7. The GMC oxidoreductase signature domain has been assigned the PFAM labels "GMC_oxred_1" and "GMC_oxred_2" under accession number PS00623 and PS00624, respectively (see the Pfam website, available online through Washington University in Saint Louis). GMC oxidoreductase signature domains are involved in oxidoreductase activity and are described in, for example, Cavener (1992) *J. Mol. Biol.* 223:811-814, the contents of which are incorporated herein by reference.

To identify the presence of a GMC oxidoreductase signature domain in an OP protein and make the determination that a protein of interest has a particular profile, the amino acid sequence of the protein is searched against a database of HMMs (e.g., the Pfam database, release 2.1) using the default parameters (see the Pfam website, available online through Washington University in Saint Louis). A search was performed against the HMM database resulting in the identification of a GMC oxidoreductase signature domain in the amino acid sequence of SEQ ID NO:55 (at about residues 41-567).

A description of the Pfam database can be found in Sonhammer et al. (1997) *Proteins* 28:405-420, and a detailed description of HMMs can be found, for example, in Gribskov et al. (1990) *Meth. Enzymol.* 183:146-159; Gribskov et al. (1987) *Proc. Natl. Acad. Sci. USA* 84:4355-4358; Krogh et al. (1994) *J. Mol. Biol.* 235:1501-1531; and Stultz et al. (1993) *Protein Sci.* 2:305-314, the contents of which are incorporated herein by reference.

Isolated OP proteins of the present invention, have an amino acid sequence sufficiently identical to the amino acid sequence of SEQ ID NO:55, or are encoded by a nucleotide sequence sufficiently identical to SEQ ID NO:54 or 56. As used herein, the term "sufficiently identical" refers to a first amino acid or nucleotide sequence which contains a sufficient or minimum number of identical or equivalent (e.g., an amino acid residue which has a similar side chain) amino acid residues or nucleotides to a second amino acid or nucleotide sequence such that the first and second amino acid or nucleotide sequences share common structural domains or motifs and/or a common functional activity. For example, amino acid or nucleotide sequences which share common structural domains have at least 30%, 40%, or 50% homology, preferably 60% homology, more preferably 70%-80%, and even more preferably 90-95% homology across the amino acid sequences of the domains and contain at least one and preferably two structural domains or motifs, are defined herein as sufficiently identical. Furthermore, amino acid or nucleotide sequences which share at least 30%, 40%, or 50%, preferably 60%, more preferably 70-80%, or 90-95% homology and share a common functional activity are defined herein as sufficiently identical.

As used interchangeably herein, a "OP activity", "biological activity of OP," or "functional activity of OP," includes an activity exerted by an OP protein, polypeptide or nucleic acid molecule on an OP-responsive cell or tissue, or on an OP protein substrate, as determined in vivo, or in vitro, according to standard techniques. In one embodiment, an OP activity is a direct activity, such as an association with an OP-target molecule. As used herein, a "target molecule" or "binding partner" is a molecule with which an OP protein binds or interacts in nature, such that OP-mediated function is achieved. An OP target molecule can be a non-OP molecule or an OP accessory polypeptide or molecule of the present invention (e.g., $NAD^+$, $FAD^+$, or other cofactor). As used herein, an "accessory" peptide or molecule refers to a peptide or molecule whose presence is may be needed for the proper activity of a protein (e.g., a cofactor or a metal ion that is needed by an enzyme). In an exemplary embodiment, an OP target molecule is an OP ligand (e.g., choline and/or an acceptor molecule to be reduced or oxidized choline and/or an acceptor molecule to be reduced or oxidized). Alternatively, an OP activity is an indirect activity, such as a cellular signaling activity mediated by interaction of the OP protein with an OP ligand. The biological activities of OP are described herein. For example, the OP proteins of the present invention can have one or more of the following activities: 1) modulation of metabolism and catabolism of biochemical molecules, e.g., molecules necessary for energy production or storage; 2) modulation of betaine synthesis from choline; 3) modulation of methionine synthesis from homocysteine; 4) modulation of intra- or inter-cellular signaling; 5) modulation of cellular proliferation and/or migration; and/or 6) modulation of hormonal responses.

Accordingly, another embodiment of the invention features isolated OP proteins and polypeptides having an OP activity. Other preferred proteins are OP proteins having one or more of the following domains: a transmembrane domain, a GMC oxidoreductase signature domain, and, preferably, an OP activity. Additional preferred OP proteins have at least one GMC oxidoreductase signature domain, and/or at least one transmembrane domain and are, preferably, encoded by a nucleic acid molecule having a nucleotide sequence which hybridizes under stringent hybridization conditions to a nucleic acid molecule comprising a complement of the nucleotide sequence of SEQ ID NO:54 or 56.

Isolation of the Human 26343 or OP cDNA

The invention is based, at least in part, on the discovery of a 65.3 kD human gene encoding a novel protein, referred to herein as 26343 or OP. The entire sequence of the human clone Fbh26343 was determined and found to contain an open reading frame termed "human OP." The 2343 nucleotide sequence encoding the human OP protein is set forth as SEQ ID NO:54. The protein encoded by this nucleic acid comprises about 594 amino acids and has the amino acid sequence set forth as SEQ ID NO:55. The coding region (open reading frame) of SEQ ID NO:54 is set forth as SEQ ID NO:56.

Analysis of the Human 26343 or OP Molecule

A search for domain consensus sequences was performed using the amino acid sequence of human 26343 or OP and a database of HMMs (the Pfam database, release 2.1) using the default parameters (described above). The search revealed a GMC oxidoreductase signature domain (Pfam label GMC_oxred; Pfam Accession Numbers PS00623 and PS00624) within SEQ ID NO:55 at residues 41-567.

A search was performed against the ProDom database resulting in the identification of a portion of the deduced amino acid sequence of human 26343 or OP (SEQ ID NO:55) which has a 39% identity to ProDom entry "FAD flavoprotein oxidoreductase precursor dehydrogenase lyase signal protein cellobiose isoform") over residues 41 to 351 and 37% identical over residues 488-568. In addition, human 26343 or OP is 50% identical to ProDom entry "L-sorbosone dehydrogenase, FAD dependent" over residues 501-573 of SEQ ID NO:55. In addition, human 26343 or OP is 57% identical to ProDom entry "NADH:N-amido-scyllo-inosamine oxidoreductase" over residues 40-74 and 32% identical over residues 254 to 308 of SEQ ID NO:55.

A search was also performed against the Prosite database, and resulted in the identification of one possible glycosaminoglycan attachment site within the human OP protein at residues 308-311 of SEQ ID NO:55. In addition, protein kinase C phosphorylation sites were identified within the human 26343 or OP protein at residues 81-83, 85-87, 283-285, 494-496, 515-517, and 592-594 of SEQ ID NO:55. This search also identified casein kinase II phosphorylation sites at residues 37-40, 231-234, 415-418, 455-458, 494-497 of SEQ ID NO:55. A tyrosine phosphorylation site motif was also identified in the human 26343 or OP protein at residues 503-510 of SEQ ID NO:55. The search also identified the presence of N-myristoylation site motifs at residues 20-25, 47-52, 129-134, 296-301, 309-314, 329-334, 374-379, and 429-434 of SEQ ID NO:55. In addition, the search identified an amidation site at residues 234-237, and a GMC oxidoreductase signature sequence at amino acids 297-311 of SEQ ID NO:55.

An analysis of the possible cellular localization of the human 26343 or OP protein based on its amino acid sequence was performed using the methods and algorithms described in Nakai and Kanehisa (1992) Genomics 14:897-911, and available online through the PSORT server website. The results from this analysis predict that the human 26343 or OP protein is found in the mitochondria, in the cytoplasm, in the nucleus, and in peroxisome.

An analysis of putative post-translationally truncated variants indicated that the mature protein may have residue 16 of SEQ ID NO:55 (arginine) as the N-terminal residue.

Analysis of Human 26343 or OP Expression

The following describes the expression of human 26343 or OP mRNA in various tissues, tumors, cell lines, and disease models, as determined using the TaqMan™ procedure and in situ hybridization analysis.

For in situ analysis, various tissues, e.g., tissues obtained from liver or colon, were first frozen on dry ice.

As indicated by the data obtained from the TaqMan analysis, human 26343 was expressed highly in the following tissues: normal fetal heart, normal brain cortex, brain (hypothalamus), brain (glioblastoma), normal breast, breast tumor (IDC), prostate tumor, colon tumor, normal kidney, normal liver, fibrotic liver, normal fetal liver, and skeletal muscle. Human 26343 is also expressed in the following tissues: normal heart, heart (congestive heart failure), normal spinal cord, normal prostate, normal ovary, and lung (chronic obstructive pulmonary disease).

Human 26343 showed increased expression in 100% of the clinical colon tumor samples tested, compared with clinical normal colon tissue samples.

Human 26343 showed increased expression in 100% of the clinical liver metastasis samples tested, compared with clinical normal liver tissue samples.

Human 26343 showed increased expression in 57% of the clinical lung tumors tested, compared with clinical normal lung tissue samples.

Human 26343 showed expression in most Xenograft friendly cell lines, e.g., MCF-7, ZR75, T47D, DLD-1, SW 480, SW 620, HCT 116, Colo 205, NCIH 125, NCIH 322, NCIH 460, and A549. Colon tumor cell lines show increased 26343 expression in later stages as follows:

| Cell line | Stage | Relative Expression |
| --- | --- | --- |
| SW 480B | | 8.0 |
| HCT 116 | B/C | 20.6 |
| DLD-1 | C | 19.9 |
| Colo 205 | Ascites | 62.5 |
| SW 620Lymph | Metastasis | 104.7 |

The results from the in situ hybridization analysis indicate that human 26343 is expressed in 100% of primary colon tumors tested and 100% of metastatic tumors tested, as compared to 0% in normal tissues tested.

The data also indicate that human 26343 is focally expressed in 20% of lung tumors tested, as compared to 0% of the corresponding normal tissues.

Cell Cycle Analysis

The following describes the results from studies designed to determine how the expression of human 26343 mRNA is regulated during the cell cycle.

Transcriptional profiling analysis showed that human OP expression was increased in aphidocholine synchronized MCF10a cells within the G0/G1 phase of the cell cycle.

Human 26343 also showed cell cycle regulated expression in aphidocholine synchronized HCT 116 colon carcinoma cells, with higher expression in the G2/M phase of the cell cycle.

Human 26343 also showed cell cycle regulated expression in aphidocholine synchronized A549 lung carcinoma cells.

Reintroduction of Smad4, a tumor suppressor gene in the TGFβ signaling pathway, into SW 480 cells (colon carcinoma cells that are deficient in the expression of Smad4) by transient transfection caused a decrease in the expression of human 26343 in these cells.

Human 26343 expression was upregulated in the RER− (replication error) cell lines Caco2 and SW 480, as compared to RER+ cell lines. RER− cell lines have increased difficulty in mismatch repair during DNA replication.

Increased expression of human 26343 in RER− cells and in Smad4 deficient cells indicates that increased human 26343 expression is associated with situations known to cause progression to later stage tumors, i.e., errors in TGFβ signaling and mismatch repair.

Measurement of Methionine Levels in Tumor Cells

The following describes the measurement of methionine levels in tumor cells, as may be determined using the methods of Tan, Y. et al. (1999) *Clin. Cancer Res.* 5:2157-2163, the contents of which are incorporated herein by reference.

Briefly, tumor methionine levels are determined using an HPLC machine (Hitachi L-5200A Intelligent pump; Hitachi, Ltd., Tokyo, Japan) after derivitization of serum amino acids with the fluoraldehyde reagent OPA as described in Tan, Y. et al. (1997) *Anticancer Res.* 17:3857-3860 and Lishko, V. K. et al. (1993) *Anticancer Res.* 13:1465-1468. Supernatants are prepared from tumor tissue after sonication for 30 seconds and subsequent centrifugation at 13,000 rpm for 10 minutes. Tumor supernatant samples (25 µl) are precipitated by acetonitrile (75 µl). Ten µl of supernatant are mixed with 5 µl of OPA. After 1 minute, 50 µl of 0.1 M sodium acetate (pH 7.0) are added, and a 20 µl sample is loaded on a reversed-phase Supelcosil LC-18-DB column (particle size: 5 µm, 25 cm×4.8 mm) at room temperature. The column is eluted with solution A (tetrahydrofuran:methanol:0.1 M sodium acetate (pH 7.2); 5:95:900) and solution B (methanol). A gradient from 20-60% of solution B, run a flow rate of 1.5 ml/min, resolves the amino acids. The eluate is read with a fluorescence spectrophotometer (Hitachi, F1000) at a wavelength of 350-450 nm. The limit of detection is ~0.1 µM methionine.

Measurement of OP Choline Dehydrogenase Activity

The following describes the measurement of OP choline dehydrogenase activity in cells, as may be determined using the methods of Zhang, J. et al. (1992) *Biochim. Biophys. Acta* 1117:333-339, the contents of which are incorporated herein by reference.

The following methods are used to assay the choline dehydrogenase activity of the OP molecules of the invention. The methods are performed with purified OP molecules, or with mitochondrial preparations containing OP molecules, as described below.

Preparation of Mitochondria

A 12 gram wet weight tissue or cell sample (e.g., a normal tissue or cell sample, or a tumor sample) is homogenized in 108 ml 0.25 M sucrose at a temperature of not more than 4° C. and centrifuged at 700×g at 4° C. for 8 minutes. The supernatant is subsequently centrifuged at 17,000×g at 4° C. for 10 minutes. The resulting mitochondrial pellet is resuspended in 30 ml of 0.25 M sucrose and repeatedly treated as above at least three times. The purity of the mitochondria is confirmed by determining the activities of a mitochondrial marker, fumarase (Stenech, J. (1984) in *Experimental Biochemistry* (Stenech, J., ed.), pp. 400-401, Allyn and Bacon, Boston); a cytosolic marker, lactate dehydrogenase (Worthington Biochemicals, Freehold, N.J.); and a microsomal marker, glucose-6-phosphatase (Leloir, L. F. and Cardini, C. E. (1975) *Methods Enzymol.* 3:840-844). This preparation is kept frozen at −90° C. until used. The protein concentration of the mitochondria is determined by the method of Bradford ((1976) *Anal. Biochem.* 72:248-254).

Colorimetric OP Choline Dehydrogenase Assay

OP choline dehydrogenase activity may be measured by the PMS-DCIP colorimetric method, as described in Singer, T. P. (1974) in *Methods of Biochemical Analysis* (Glick, D., ed.), Vol. 22, pp. 133-169, John Wiley, New York; and Rendina, G. and Singer, T. P. (1959) *J. Biol. Chem.* 234:1605-1610.

Radioenzymatic Assay of OP Choline Dehydrogenase Activity

A mitochondrial preparation containing OP molecules, made using the methods described above, is incubated with [methyl-$^{14}$C]choline (55 mCi/mmol; ICN Biomedicals, Irvine, Calif.) in reaction medium containing 40 mM Tris buffer (pH 7.6) or 40 mM glycine buffer (pH 8.5) for varying amounts of time at 37° C. The reaction is inactivated by adding 1/10 of the reaction volume in the form of 1.2 M HCl. Mixtures are extracted with one reaction volume of methanol and 2 volumes of chloroform. After briefly vortexing at room temperature, the phases are separated by low speed centrifugation and collected.

HPLC Purification of Choline, Betaine Aldehyde, and Betaine

50 µl of the methanol-water phase (see above) is mixed with 100 µl of methanol and then analyzed by HPLC (3×8C Pecosphere Cartridge, silica column (Perkin Elmer, Norwalk, Conn.)). The reaction products are eluted (at a flow rate of 1.5 ml/minute) with buffer A containing 800 ml acetonitrile, 68 ml ethanol, 5 ml of 3:2 (v/v) 1.0 M ammonium acetate-glacial acetic acid buffer, 127 ml water, and 10 ml 1.0 M potassium dihydrogen phosphate. The radioactivity of the eluent is determined using an on-line solid scintillant radiometric detector (Model BL 507A, Berthold, Nashua, N.H.). The efficiency of detection is determined using radiolabeled standards. After each sample is run, the column is washed for 5 minutes with buffer B containing the same components as buffer A in the following volumes (ml): 400:68:132:400:10. In a typical chromatogram, only the three peaks of interest are detected, i.e., the [methyl-$^{14}$C]choline substrate, and the two oxidation products, betaine aldehyde and betaine (betaine aldehyde is an intermediate in the two-step oxidation process that produces betaine from choline). The combined radioactivity in these three peaks is taken as 100%. In order to determine the amount of each product formed, the following formula is used:

$$\text{moles of product} = \frac{DPM \text{ in peak}}{\text{total } DPM}$$

moles choline substrate in incubation medium

Partial Purification of OP Choline Dehydrogenase

Mitochondria are centrifuged at 17,000×g at 4° C. to remove the original buffer. The mitochondrial pellet is resuspended in 1.2 M sucrose, 0.05 mM EDTA, and 40 mM ammonium acetate for 45 minutes at 25° C. The resulting preparation is centrifuged at 24,000×g at 4° C. for 10 minutes (Beckman, Ti 50.2 rotor). The resulting pellet is referred to interchangeably herein as an "aged mitochondrial pellet" or "aged mitochondria" (Lin, C. S. and Wu, R. D. (1986) *J. Prot. Chem.* 5:193-200).

The aged mitochondrial pellet is resuspended by gentle stirring in 60 mM glycine-NaOH buffer (pH 10) at 4° C. for 40 minutes. The resulting preparation is centrifuged at 24,000×g at 4° C. for 10 minutes. The supernatant is discarded after centrifugation.

The pellet is extracted with 0.2 mg digitonin per mg protein. Digitonin is dissolved in 0.25 M warm sucrose and sonicated with a probe sonicator for 1-2 minutes and then chilled and gently added drop-wise to the mitochondrial preparation over a 5 minutes period. After incubation for 25 minutes at 4° C., the preparation is centrifuged at 24,000×g at 4° C. for 10 minutes. The pellet is resuspended in 0.25 M NaCl (Lin and Wu (1986) supra).

The digitonin-extracted mitochondrial preparation in 0.25 M NaCl is sonicated at 4° C. for 5 minutes and subsequently centrifuged at 100,000×g at 4° C. for 30 minutes (Beckman, Ti 50.2 rotor). The pellet is resuspended in a buffer containing 0.12 M sucrose, 0.05 mM EDTA, 6.0 mM choline (Fisher, Springfield, N.J.; recrystallized in methanol), 0.03 M potassium phosphate, and 1.0 M NaCl. Lubrol WX (0.2 mg per mg protein; Serva, Feinbiochemica, Heidelberg, Germany) is added, the preparation is shaken for 10 minutes at 4° C. and subsequently centrifuged at 100,000×g for 30 minutes. The solubilized OP molecules are present in the supernatant (Lin and Wu (1986) supra).

Thin Layer Chromatography Separation of Choline Oxidation Product

Choline, betaine aldehyde, and betaine are purified by thin layer chromatography on silica gel plates (LK5D; Whatman Company) developed with a mixture containing chloroform, methanol, and 0.1 M HCl (65:30:4; v/v) and visualized by staining in iodine vapor.

Measurement of OP Choline Dehydrogenase Activity

In one experiment, 62.5 µg OP protein (mitochondrial preparation) is incubated with 0.572 µCi, 0.15 mM [methyl-$^{14}$C]choline in Tris buffer (pH 7.6) at 37° C. The total reaction volume is 150 µl. In another experiment, 31.5 µg OP protein (mitochondrial preparation) is incubated with 0.27 µCi, 0.13 mM [methyl-$^{14}$C]choline in Tris buffer (pH 8.5) at 37° C. The total reaction volume is 150 µl. In still another experiment, varying amounts of OP protein (mitochondrial preparation) are incubated with 0.92 µCi, 0.2 mM [methyl-$^{14}$C]choline in Tris buffer (pH 7.6) for 10 minutes at 37° C. The total reaction volume is 150 µl.

In another experiment, the effect of electron acceptors and cyanide on OP activity is measured. 0.5 mg of OP protein (mitochondrial preparation) is incubated with 0.1 mM, 0.41 µCi [methyl-$^{14}$C]choline in Kregs-Hanseleit buffer (pH 7.75), in the presence of 1 mM potassium cyanide (KCN), phenazine methosulfate (PMS) and dichloroindophenol (DCIP), or PMS, DCIP, and KCN. The total reaction volume is 0.5 ml. The reaction mixture is incubated at 37° C. for 20 minutes. In another experiment, 11 µg OP protein (solubilized preparation) is incubated with 20 nmol, 0.27 µCi [methyl-$^{14}$C]choline at 37° C. in 0.01 M $KH_2PO_4$ (pH 7.7) for 40 minutes in the presence or absence of 0.1 mM $NAD^+$, or 1.0 mM PMS, or 0.1 mM PMS and 0.1 mM $NAD^+$ together. The total reaction volume is 195 µl.

In another experiment, the effect of changes in pH on OP activity is measured. 63 µg OP protein is incubated in 40 mM phosphate, 40 mM glycine, 40 mM Hepes, 40 mM boric acid, or 40 mM Tris buffer at different pH. The [methyl-$^{14}$C]choline concentration is 0.8 µCi, 0.19 mM for Tris-HCl and phosphate buffer, and 0.25 µCi, 0.13 mM for other buffers. The reactions are carried out at 37° C. for 10 minutes.

Human 56638

The present invention is based, at least in part, on the identification of a novel neprilysin protease referred to herein as "56638". The human 56638 sequence (SEQ ID NO:57), which is approximately 2953 nucleotides long including untranslated regions, contains a predicted methionine-initiated coding sequence of about 2340 nucleotides, including the stop codon (SEQ ID NO:59). Although the ATG at position 1-3 of SEQ ID NO:59 is the preferred start site of translation, other embodiments are included wherein, e.g., the ATG at position 28-30 of SEQ ID NO:59 is the start site of translation. The coding sequence encodes an 779 amino acid protein (SEQ ID NO:58). The human 56638 protein of SEQ ID NO:58 is predicted to have a signal peptide at about amino acid 1-44 of SEQ ID NO:58.

Human 56638 sequence contains the following regions or other structural features: an M13 peptidase (neprilysin) domain (PF01431) from about amino acid 572 to 778 of SEQ ID NO:58, which includes the characteristic HEXXH zinc-binding active site of metallopeptidases (PS00142; SEQ ID NO:62) located at about amino acid 610 to 619 of SEQ ID NO:58.

The human 56638 sequence can additionally include: eight N-glycosylation sites (PS00001) located from about amino acid 156 to 159, from about amino acid 177 to 180, from about amino acid 207 to 210, from about amino acid 243 to 246, from about amino acid 350 to 353, from about amino acid 530 to 533, from about amino acid 638 to 641, and from about amino acid 657 to 660 of SEQ ID NO:58; one cAMP and cGMP-dependent protein kinase phosphorylation site (PS00004) from about amino acid 183 to 186 of SEQ ID NO:58; eleven protein kinase C phosphorylation sites (PS00005) from about amino acid 158 to 160, from about amino acid 244 to 246, from about amino acid 269 to 271, from about amino acid 361 to 363, from about amino acid 391 to 393, from about amino acid 412 to 414, from about amino acid 493 to 495, from about amino acid 503 to 505, from about amino acid 551 to 553, from about amino acid 726 to 728, and from about amino acid 735 to 737 of SEQ ID NO:58; eight casein kinase II phosphorylation sites (PS00006) from about amino acid 137 to 140, from about amino acid 158 to 161, from about amino acid 179 to 182, from about amino acid 429 to 432, from about amino acid 445 to 448, from about amino acid 482 to 485, from about amino acid 503 to 506, and from about amino acid 673 to 676 of SEQ ID NO:58; three tyrosine kinase phosphorylation sites (PS00007) from about amino acid 435 to 442, from about amino acid 520 to 526, and from about amino acid 645 to 653 of SEQ ID NO:58; nine N-myristoylation sites (PS00008) from about amino acid 9 to 14, from about amino acid 44 to 49, from about amino acid 78 to 83, from about amino acid 93 to 98, from about amino acid 547 to 552, from about amino acid 608 to 613, from about amino acid 683 to 688, from about amino acid 706 to 711, and from about amino acid 750 to 755 of SEQ ID NO:58; a prenyl group binding site (CAAX box) (PS00294) from about amino acid 776 to 779 of SEQ ID NO:58; and a signal peptide from about amino acid 1 to 44 of SEQ ID NO:58, resulting in a mature protein of 822 amino acids, from amino acid 45 to 779 of SEQ ID NO:58.

Polypeptides of the invention include fragments which include: all or part of a hydrophobic sequence, e.g., the sequence of 560-570 of SEQ ID NO:58; all or part of a hydrophilic sequence, e.g., the sequence of 620-640 of SEQ ID NO:58; a sequence which includes a Cys or a glycosylation site.

For general information regarding PFAM identifiers, PS prefix and PF prefix domain identification numbers, refer to Sonnhammer et al. (1997) *Protein* 28:405-420.

The 56638 protein contains a significant number of structural characteristics in common with members of the neprilysin family of metalloproteases.

The neprilysin family comprises a number of related enzymes that share high structural homology and a common catalytic mechanism that involves cleavage of a protein substrate by hydrolysis of an amide bond that depends upon the presence of a metal ion, e.g., zinc. Neprilysins are mammalian membrane metalloproteases which contain the active site consensus sequence VxxHExxH (SEQ ID NO:61; amino acids 610 to 619 of SEQ ID NO:58) found in other zinc metalloproteases. The histidines are two of the three Zn-coordinating ligands, and the glutamate plays a role in catalysis by polarizing a water molecule. The hydrolysis occurs through the formation of a pentacoordinated complex of the metal which includes the three Zn-coordinating amino acids of the peptidase, the oxygen of the scissile bond, and the water molecule that is initially bound to the Zn atom. For a review, see, Barrett (1995) *Methods in Enzymol* 248:263-283. In addition, neprilysin family members share other structural features. They can be highly glycosylated type II integral membrane proteins, and they can have a cluster of conserved cysteine residues following the transmembrane domain which are involved in stabilizing the active enzyme through the formation of sulfide bridges (Tanja et al (2000) *Biochem Biophys Res Comm* 271:565-570).

The human 56638 proteins of the present invention show significant homology to members of the neprilysin metallopeptidase family, and in particular, to the mouse NL1/SEP and the rat neprilysin II proteins (Ghaddar et al. (2000) *Biochem J* 347:419-429; Ikeda et al. (1999) *J Biol Chem* 274: 32469-32477). Like mouse NL1/SEP and rat neprilysin II, 56638 is a secreted protein. 56638 has the characteristic Vxx-HExxH (SEQ ID NO:61) zinc-binding metallopeptidase consensus sequence (PS00142), located at about amino acid 610 to 619 of SEQ ID NO:58. Neprilysin family members include neprilysin, endothelin converting enzyme (ECE), Kell Blood group antigen, PEX, and X-converting enzyme (XCE), and a soluble secreted endopeptidase (SSE). Examples of substrates of the neprilysin peptidase family include, but are not limited to, neuropeptides involved in pain control, e.g., enkephalin, somatostatin, and substance P; and vasoactive peptides that mediate inflammation and pain, e.g., neurotensin, atrial natriuretic peptide (ANP), neurokinin, tachykinin, bradykinin, and endothelin (Checler et al. (1983) *J Neurochem* 41:375; Matsas et al. (1983) *Proc Natl Acad Sci USA* 80:3111; Matsas et al. (1984) *Biochem J* 223:433; Stepehenson and Kenny (1987) *Biochem J* 241:237; Turner and Tanzawa (1997) *FASEB J* 11:355-364). Mouse NL1/Sep has been shown to cleave enkephalin in vivo. Enkephalin, a major substrate of neprilysin, is one of several naturally occurring morphine like substances released from nerve endings of the central nervous system and the adrenal medulla. It acts as an analgesic and sedative in the body and appears to affect mood and motivation. As neprilysin is responsible for the inactivation of enkephalin and other bioactive peptides involved in inflammation and pain, neprilysins are critical for the proper function of many physiological systems, including neurotransmission, pain control, inflammatory response, and vascular tone.

Other neprilysin family members include a marker of common acute lymphoblastic leukemia antigen present at the surface of B cells (Roques et al. (1993) *Pharmacol Rev* 45:87), and the Kell blood group antigen (Lee et al. (1999) *Proc Natl Acad Sci USA* 88:6353-6357). Kell antigens are highly immunogenic and may cause severe fetal anemia in sensitized mothers, erythroblastosis in newborn infants, and severe hemolytic reactions if mismatched blood is transfused.

A 56638 polypeptide can include a "neprilysin domain" or regions homologous with a "neprilysin domain." A 56638 polypeptide can optionally further include a signal peptide; at least one, two, three, four, five, six, seven, preferably eight N-glycosylation sites; at least one cAMP and cGMP-dependent protein kinase phosphorylation site; at least one, two, three, four, five, six, seven, eight, nine, ten, preferably eleven, protein kinase C phosphorylation sites; at least one, two, three, four, five, six, seven, preferably eight, casein kinase II phosphorylation sites; at least one, two, preferably three, tyrosine kinase phosphorylation sites; at least one, two, three, four, five, six, seven, eight, preferably nine, N-myristoylation sites; at least one prenyl group binding site.

As used herein, the term "neprilysin domain" includes an amino acid sequence of about 50 to 350 amino acid residues in length, more preferably about 100 to 300 amino acid residues, or about 200 to 215 amino acids, and having a bit score for the alignment of the sequence to the neprilysin domain (HMM) of at least 100, preferably 150, more preferably 200, most preferably 250 or more. Preferably, the domain includes a zinc-binding active site of metallopeptidase domains (PS00142) located at about amino acid 610 to 619 of SEQ ID NO:58. The neprilysin domain (HMM) has been assigned the PFAM Accession Number PF01431. An alignment of the neprilysin domain (amino acids 572 to 778 of SEQ ID NO:58) of human 56638 with a consensus amino acid sequence derived from a hidden Markov model derived from PFAM (SEQ ID NO:60) yields a bit score for the alignment of 270.4 (E=2.4e-77).

In a preferred embodiment 56638 polypeptide or protein has a "neprilysin domain" or a region which includes at least about 50 to 350, more preferably about 100 to 300, or 200 to 215 amino acid residues and has at least about 60%, 70% 80% 90% 95%, 99%, or 100% homology with a "neprilysin," e.g., the neprilysin domain of human 56638 (e.g., residues 572 to 778 of SEQ ID NO:58).

To identify the presence of a "neprilysin" domain in a 56638 protein sequence, and make the determination that a polypeptide or protein of interest has a particular profile, the amino acid sequence of the protein can be searched against a database of HMMs (e.g., the Pfam database, release 2.1) using the default parameters. For example, the hmmsf program, which is available as part of the HMMER package of search programs, is a family specific default program for MILPAT0063 and a score of 15 is the default threshold score for determining a hit. Alternatively, the threshold score for determining a hit can be lowered (e.g., to 8 bits). A description of the Pfam database can be found in Sonhammer et al. (1997) *Proteins* 28(3):405-420 and a detailed description of HMMs can be found, for example, in Gribskov et al. (1990) *Meth Enzymol* 183:146-159; Gribskov et al. (1987) *Proc Natl Acad Sci USA* 84:4355-4358; Krogh et al. (1994) *J Mol Biol.* 235: 1501-1531; and Stultz et al. (1993) *Protein Sci* 2:305-314, the contents of which are incorporated herein by reference. A search was performed against the HMM database resulting in the identification of a "neprilysin" domain in the amino acid sequence of human 56638 at about residues 572 to 778 of SEQ ID NO:58. The identified neprilysin domain is depicted in SEQ ID NO:60.

A 56638 protein can further include a signal peptide, and is predicted to be a secreted protein. As used herein, a "signal peptide" or "signal sequence" refers to a peptide of about 20 to 60, preferably about 30 to 50, more preferably, about 44 amino acid residues in length which occurs at the N-terminus of secretory and integral membrane proteins and which contains a majority of hydrophobic amino acid residues. For example, a signal sequence contains at least about 20 to 60, preferably about 30 to 50, more preferably, 44 amino acid residues, and has at least about 40-70%, preferably about 50-65%, and more preferably about 55-60% hydrophobic amino acid residues (e.g., alanine, valine, leucine, isoleucine, phenylalanine, tyrosine, tryptophan, or proline). Such a "signal sequence", also referred to in the art as a "signal peptide," serves to direct a protein containing such a sequence to a lipid bilayer. For example, in one embodiment, a 56638 protein contains a signal sequence of about amino acids 1 to 44 of SEQ ID NO:58. The "signal sequence" is cleaved during processing of the mature protein. The mature 56638 protein corresponds to amino acids 45 to 778 of SEQ ID NO:58.

As used herein, a "56638 activity," "biological activity of 56638," or "functional activity of 56638," refers to an activity exerted by a 56638 protein, polypeptide or nucleic acid molecule on e.g., a 56638-responsive cell or on a 56638 substrate, e.g., a protein substrate, as determined in vivo or in vitro. In one embodiment, a 56638 activity is a direct activity, such as an association with a 56638 target molecule. A "target molecule" "substrate" or "binding partner" is a molecule with which a 56638 protein binds or interacts in nature. A 56638 activity can also be an indirect activity, e.g., a cellular signaling activity mediated by interaction of the 56638 protein with a 56638 binding partner. In an exemplary embodiment, 56638 is an enzyme for an enkephalin substrate.

Based on the above-described sequence similarities and the tissue distribution described below, the 56638 molecules of the present invention are predicted to have similar biological activities as neprilysin metalloprotease family members. Thus, in accordance with the invention, a 56638 metalloprotease or subsequence or variant polypeptide may have one or more domains and, therefore, one or more activities or functions characteristic of a neprilysin metalloprotease family member, including, but not limited to, (1) the ability to modulate the activity of a bioactive peptide, (2) the ability to cleave a neprilysin substrate, e.g., enkephalin, (3) the ability to modulate pain or inflammation response, (4) the ability to modulate spermatid cell activity or infertility, or (5) the ability to modulate hematopoietic cell activity, e.g., erythroid cell activity or B cell activity. Thus, the 56638 molecules can act as novel diagnostic targets and therapeutic agents for controlling neprilysin associated disorders.

Neprilysin is involved in the inactivation of the opioid enkephalins in the brain, which induce analgesic responses. Inhibitors of neprilysin are thus able to potentiate the analgesic effects of exogenous enkephalins, as evaluated by analgesic tests on animals, e.g., the hot plate test, tail flick test, writhing test, paw pressure test, all electric stimulation test, tail withdrawal test, or formalin test (Roques et al. (1995) *Methods in Enzymology* 248:263-283). Thus, 56638 neprilysin or subsequence or variant having neprilysin activity is capable of cleaving one or more protein substrates, e.g., biologically active neuropeptides, e.g., enkephalin, substance P, or somatostatin, to modulate pain response.

Neprilysin family members are also involved in the inflammatory response. Besides, enkephalin, other neprilysin substrates include endothelin (a polypeptide produced by endothelial cells that stimulates contraction of the underlying smooth muscle of blood vessel walls), and vasoactive peptides that cause vasodilation and pain, e.g., neurotensin, atrial natriuretic peptide (ANP), neurokinin, tachykinin, bradykinin, and endothelin.

TaqMan analysis revealed that 56638 mRNA is expressed in human adrenal gland, brain, heart, kidney, liver, lung, mammary gland, placenta, prostate, salivary gland, muscle, small intestine, spleen, stomach, testes, thymus, trachea, uterus, spinal cord, skin, and dorsal root ganglion (DRG). The highest 56638 mRNA expression was observed in testes, trachea, brain, spinal cord and DRG.

As 56638 mRNA is highly expressed in human testis, it suggests a role for 56638 in, e.g., fertility or spermatid development. Human 56638 appears to be a human orthologue of mouse neprilyisn NL1/SEP and the rat neprilysin II proteins (Ghaddar et al. (2000) *Biochem J* 347:419-429; Tanja et al. (2000)*Biochem Biophys Res Comm* 271:565-570). Like 56638, mouse NL1/SEP and rat neprilysin II are highly expressed in testis, and are secreted proteins. The rat and mouse proteins have been localized to the seminiferous tubules and, specifically, to spermatids (Ibid). Testicular neprilysin enzymes may act to modulate enkephalins acting as intratesticular paracrine/autocrine factors. Thus, the 56638 molecules can act as novel diagnostic targets and therapeutic agents controlling sperm formation or other processes related to fertility, e.g., spermatogenesis or fertilization.

As 56638 mRNA is highly expressed in human trachea, it also suggests a role for 56638 in modulation of the activity of bioactive peptides in the trachea, bronchus, and lung. Thus, the 56638 molecules can act as novel diagnostic targets and therapeutic agents controlling respiratory disorders, e.g., chronic obstructive pulmonary disease, emphysema, amyloidosis, lung disease, lung cancer, sleep apnea, bronchitis, pneumonias, silicosis, pulmonary edema, interstitial restrictive lung diseases, pulmonary embolus, or pulmonary hypertension.

56638 mRNA is also highly and widely expressed in the central and peripheral nervous system. More specifically, high levels of 56638 mRNA expression were found in human brain, spinal cord and DRG. Taqman experiments in rat showed that 56638 is expressed in pituitary gland, spinal cord, brain, nerve, TRG, and DRG. In situ hybridization with a 56638 probe shows that 56638 is heterogeneously expressed in monkey CNS, including expression in cerebral cortex, spinal cord, brain stem nucleus and hypothalamus. Hence, 56638 is likely a neuropeptidase, e.g., a neuropeptidase involved in pain response.

Animal models of pain response include, but are not limited to, axotomy, the cutting or severing of an axon; chronic constriction injury (CCI), a model of neuropathic pain which involves ligation of the sciatic nerve in rodents, e.g., rats; or intraplantar Freund's adjuvant injection as a model of arthritic pain. Other animal models of pain response are described in, e.g., ILAR Journal (1999) Volume 40, Number 3 (entire issue). Taqman experiments on rodent models of pain response showed that the 56638 gene is up-regulated in DRG seven days after axotomy and seven days after CCI. In situ hybridization experiments in rat pain models show up-regulation of the 56638 gene one and seven days after axotomy and after complete Freund's adjuvant intraplantar injection. These levels go back to normal at later time points. No contralateral effects were observed. These experiments indicate a role for the 56638 molecule in pain response.

Therefore, neprilysin and 56638 associated disorders can detrimentally affect regulation and modulation of the pain response; and vasoconstriction, inflammatory response and pain therefrom. Examples of neprilysin associated disorders in which the 56638 molecules of the invention may be directly or indirectly involved include pain, pain syndromes, and inflammatory disorders, including inflammatory pain.

As the 56638 polypeptides of the invention may modulate 56638-mediated activities, they may be useful for developing novel diagnostic and therapeutic agents for 56638-mediated or related disorders. For example, the 56638 molecules can act as novel diagnostic targets and therapeutic agents controlling pain, pain disorders, and inflammatory disorders. For example, a 56638 inhibitor can be useful in the treatment of pain, as 56638 inhibition could increase the endogenous levels of enkephalins and thereby increase the associated analgesic response.

The 56638 molecules can also act as novel diagnostic targets and therapeutic agents controlling pain caused by other disorders, e.g., cancer, e.g., prostate cancer. For example, endothelin, which is inactivated by neprilysin, is associated with the excruciating, debilitating pain that comes when prostate cancer invades the bone (reviewed in Nelson and Carducci (2000) *BJU Int* 85 Suppl 2:45-8). In addition, a neprolysin family member can be a marker of common acute lymphoblastic leukemia antigen present at the surface of B cells (Roques et al. (1993) *Pharmacol Rev* 45:87). Accordingly, the 56638 molecules can act as novel diagnostic targets and therapeutic agents for controlling one or more of cellular proliferative and/or differentiative disorders, or pain therefrom.

The 56638 molecules can also act as novel diagnostic targets and therapeutic agents for brain disorders.

In addition, a neprolysin family member can be a Kell blood group antigen (Lee et al. (1999) *Proc Natl Acad Sci USA* 88:6353-6357). Kell antigens are highly immunogenic and may cause severe fetal anemia in sensitized mothers, erythroblastosis in newborn infants, and severe hemolytic reactions if mismatched blood is transfused. Therefore, the 56638 molecules can also act as novel diagnostic targets and therapeutic agents controlling disorders related to hematopoietic cells, e.g., blood cell- (e.g., erythroid-) associated disorders, e.g., anemia, or erythroblastosis.

The 56638 nucleic acid and protein of the invention can be used to treat and/or diagnose a variety of immune disorders.

Identification and Characterization of Human 56638 cDNA

The human 56638 sequence (SEQ ID NO:57), which is approximately 2953 nucleotides long, including untranslated regions, contains a predicted methionine-initiated coding sequence of about 2340 nucleotides, including the termination codon (nucleotides indicated as "coding" of SEQ ID NO:57; SEQ ID NO:59). The coding sequence encodes a 779 amino acid protein (SEQ ID NO:58).

Tissue Distribution of 56638 mRNA

Endogenous human 56638 gene expression was determined using the Perkin-Elmer/ABI 7700 Sequence Detection System which employs TaqMan technology.

To determine the level of 56638 in various human tissues a primer/probe set was designed using Primer Express (Perkin-Elmer) software and primary cDNA sequence information. Total RNA was prepared from a series of human tissues using an RNeasy kit from Qiagen. First strand cDNA was prepared from 1 µg total RNA using an oligo-dT primer and Superscript II reverse transcriptase (Gibco/BRL). cDNA obtained from approximately 50 ng total RNA was used per TaqMan reaction. 56638 mRNA levels were analyzed in a variety of samples of human tissues, and in rodent models of pain response.

Relative 56638 mRNA expression was determined using mRNA derived from human tissue samples, both normal, and tumor. The samples are derived from human adrenal gland, brain, heart, kidney, liver, lung, mammary gland, placenta, prostate, salivary gland, muscle, small intestine, spleen, stomach, testes, thymus, trachea, uterus, spinal cord, skin, and dorsal root ganglion (DRG). The highest 56638 mRNA expression was observed in spinal cord, DRG, small intestine, testes, and trachea.

TaqMan experiments in rat showed that 56638 is expressed in pituitary gland, spinal cord, brain, nerve, TRG and DRG. TaqMan experiments on rodent models of pain response showed that the 56638 gene is up-regulated in DRG 7 days after axotomy and in the CCI model of neuropathic pain (7 days). No regulation was observed in the model of inflammatory pain, and there was no regulation in rat spinal cord in any of the models analyzed.

In situ hybridization experiments with the human 56638 probe showed expression in monkey brain, a subpopulation of DRG neurons, in the epithelium of trachea, and small intestine, as well as skin. In situ hybridization in rat animal models show up-regulation of the 56638 gene one and seven days after axotomy and after CFA intraplantar injection. These levels go back to normal at later time points. No contralateral effects were observed.

Human 18610

The present invention is based, at least in part, on the discovery of novel molecules, referred to herein as "t ransient r eceptor", "TR-1" or "18610" nucleic acid and polypeptide molecules, which are novel members of the transient receptor potential channel family. Transient receptor potential channel family members are ion channels, e.g., calcium channels. These novel molecules are capable of, for example, modulating an ion-channel mediated activity (e.g., a calcium channel-mediated activity) in a cell, e.g., a neuronal, muscle (e.g., cardiac muscle), or liver cell.

Calcium signaling has been implicated in the regulation of a variety of cellular responses, such as growth and differentiation. There are two general methods by which intracellular concentrations of calcium ions may be increased: calcium ions may be freed from intracellular stores, transported by specific membrane channels in the storage organelle, or calcium ions may be brought into the cell from the extracellular milieu through the use of specific channels in the cellular membrane. In the situation in which the intracellular stores of calcium have been depleted, a specific type of calcium channel, termed a 'capacitative calcium channel' or a 'store-operated calcium channel' (SOC), is activated in the plasma membrane to import calcium ions from the extracellular environment to the cytosol (see Putney and McKay (1999) *BioEssays* 21:38-46). Calcium may also enter the cell via receptor-stimulated cation channels (see Hofmann et al. (2000) *J. Mol. Med.* 78:14-25).

Members of the capacitative calcium channel family include the calcium release-activated calcium current (CRAC) (Hoth and Penner (1992) *Nature* 355: 353-355), calcium release-activated non-selective cation current (CRANC) (Krause et al. (1996) *J. Biol. Chem.* 271: 32523-32528), and the transient receptor potential (TRP) proteins TRP1, TRP2, TRP4, and TRP5. Depletion of intracellular calcium stores activate these channels by a mechanism which is yet undefined, but which has been demonstrated to involve a diffusible factor using studies in which calcium stores were artificially depleted (e.g., by the introduction of chelators into the cell, by activating phospholipase $C_\gamma$, or by inhibiting those enzymes responsible for pumping calcium ions into the stores or those enzymes responsible for maintaining resting intracellular calcium ion concentrations) (Putney, J. W. (1986) *Cell Calcium* 7:1-12; Putney, J. W. (1990) *Cell Calcium* 11:611-624).

Recently, it has been elucidated that three TRP family members, TRP3, TRP6, and a mouse homologue, TRP7, form a sub-family of receptors that are activated in a calcium store-depletion independent manner. TRP3 and TRP6 are activated by diacylglycerols in a membrane delimited manner (Hofmann et al. (1999) *Nature* 397:259-263). Similarly, murine TRP7 is activated via diacylglycerol stimulation by $G_q$ protein coupled receptors (Okada et al. (1999) *J. Biol. Chem.* 274:27359-27370).

The TRP channel family is one of the best characterized calcium channel protein families. These channels include transient receptor potential proteins and homologues thereof (to date, seven TRP homologues and splice variants have been identified in a variety of organisms), the vanilloid receptor subtype I (also known as the capsaicin receptor); the stretch-inhibitable non-selective cation channel (SIC); the olfactory, mechanosensitive channel; the insulin-like growth factor I-regulated calcium channel; the vitamin D-responsive apical, epithelial calcium channel (ECaC); and melastatin, and the polycystic kidney disease protein family (see, e.g., Montell and Rubin (1989) *Neuron* 2:1313-1323; Caterina et al. (1997) *Nature* 389: 816-824; Suzuki et al. (1999) *J. Biol. Chem.* 274: 6330-6335; Kiselyov et al. (1998) *Nature* 396: 478-482; Hoenderop et al. (1999) *J. Biol. Chem.* 274: 8375-8378; and Chen et al. (1999) *Nature* 401(6751): 383-386). Each of these molecules is 700 or more amino acids in length, and shares certain conserved structural features. Predominant among these structural features are six transmembrane domains, with an additional hydrophobic loop present between the fifth and sixth transmembrane domains. It is believed that this loop is integral to the activity of the pore of the channel formed upon membrane insertion (Hardie and Minke (1993) *Trends Neurosci* 16: 371-376). Although found in disparate tissues and organisms, members of the TRP channel protein family all serve to transduce signals by means of calcium entry into cells, particularly pain signals (see, e.g., McClesky and Gold (1999) *Annu. Rev. Physiol.* 61: 835-856; Harteneck, C. (2000) *Trends Neurosci.* 23(4):159), light signals (Hardie and Minke, supra), or olfactory signals (Colbert et al. (1997) *J. Neurosci* 17(21): 8259-8269). Thus, this family of molecules may play important roles in sensory signal transduction in general.

As used herein, an "ion channel" includes a protein or polypeptide which is involved in receiving, conducting, and transmitting signals in an electrically excitable cell, e.g., a neuronal or muscle cell. Ion channels include calcium channels, potassium channels, and sodium channels. As used herein, a "calcium channel" includes a protein or polypeptide which is involved in receiving, conducting, and transmitting calcium ion-based signals in an electrically excitable cell. Calcium channels are calcium ion selective, and can determine membrane excitability (the ability of, for example, a neuronal cell to respond to a stimulus and to convert it into a sensory impulse). Calcium channels can also influence the resting potential of membranes, wave forms and frequencies of action potentials, and thresholds of excitation. Calcium channels are typically expressed in electrically excitable cells, e.g., neuronal cells, and may form heteromultimeric structures (e.g., composed of more than one type of subunit). Calcium channels may also be found in non-excitable cells (e.g., adipose cells or liver cells), where they may play a role in, e.g., signal transduction. Calcium channels are described in, for example, Davila et al. (1999) *Annals New York Academy of Sciences* 868:102-17 and McEnery, M. W. et al. (1998) *J. Bioenergetics and Biomembranes* 30(4): 409-418, the contents of which are incorporated herein by reference. As the TR-1 molecules of the present invention are calcium channels modulating ion channel mediated activities (e.g., calcium channel mediated activities), they may be useful for developing novel diagnostic and therapeutic agents for ion channel associated disorders (e.g., calcium channel associated disorders).

As used herein, an "ion channel associated disorder" includes a disorder, disease or condition which is characterized by a misregulation of an ion channel mediated activity. For example, a "calcium channel associated disorder" includes a disorder, disease or condition which is characterized by a misregulation of a calcium channel mediated activity. Ion channel associated disorders, e.g., calcium channel associated disorders, include but are not limited to CNS disorders, pain disorders, cellular proliferation, growth, differentiation, or migration disorders.

As used herein, the term "pain signaling mechanisms" includes the cellular mechanisms involved in the development and regulation of pain, e.g., pain elicited by noxious chemical, mechanical, or thermal stimuli, in a subject, e.g., a mammal such as a human. In mammals, the initial detection of noxious chemical, mechanical, or thermal stimuli, a process referred to as "nociception", occurs predominantly at the peripheral terminals of specialized, small diameter sensory neurons. These sensory neurons transmit the information to the central nervous system, evoking a perception of pain or discomfort and initiating appropriate protective reflexes. The TR-1 molecules of the present invention may be present on these sensory neurons and, thus, may be involved in detecting these noxious chemical, mechanical, or thermal stimuli and transducing this information into membrane depolarization events. Thus, the TR-1 molecules by participating in pain signaling mechanisms, may modulate pain elicitation and act as targets for developing novel diagnostic targets and therapeutic agents to control pain.

As used herein, a "cellular proliferation, growth, differentiation, or migration process" is a process by which a cell increases in number, size or content, by which a cell develops a specialized set of characteristics which differ from that of other cells, or by which a cell moves closer to or further from a particular location or stimulus. The TR-1 molecules of the present invention are involved in signal transduction mechanisms, which are known to be involved in cellular growth, differentiation, and migration processes. Thus, the TR-1 molecules may modulate cellular growth, differentiation, or migration, and may play a role in disorders characterized by aberrantly regulated growth, differentiation, or migration. Such disorders include cancer, e.g., carcinoma, sarcoma, or leukemia; tumor angiogenesis and metastasis; skeletal dysplasia; neuronal deficiencies resulting from impaired neural induction and patterning; hepatic disorders; cardiovascular disorders; and hematopoietic and/or myeloproliferative disorders.

As used herein, an "ion channel mediated activity" includes an activity which involves an ion channel, e.g., an ion channel in a neuronal cell, a muscular cell, or a liver cell, associated with receiving, conducting, and transmitting signals, in, for example, the nervous system. Ion channel mediated activities (e.g., calcium channel mediated activities) include release of neurotransmitters or second messenger molecules (e.g., dopamine or norepinephrine), from cells, e.g., neuronal cells; modulation of resting potential of membranes, wave forms and frequencies of action potentials, and thresholds of excitation; participation in signal transduction pathways, and modulation of processes such as integration of sub-threshold synaptic responses and the conductance of back-propagating action potentials in, for example, neuronal cells (e.g., changes in those action potentials resulting in a morphological or differentiative response in the cell).

The family of TR-1 polypeptides comprise at least one "transmembrane domain" and preferably six transmembrane domains. As used herein, the term "transmembrane domain" includes an amino acid sequence of about 10-30 amino acid residues in length which spans the plasma membrane. More preferably, a transmembrane domain includes about at least 10, 15, 20, 25, or 30 amino acid residues and spans the plasma membrane. Transmembrane domains are rich in hydrophobic residues, and typically have an alpha-helical structure. In a preferred embodiment, at least 50%, 60%, 70%, 80%, 90%, 95% or more of the amino acids of a transmembrane domain are hydrophobic, e.g., leucines, isoleucines, alanines, valines, phenylalanines, prolines or methionines. Transmembrane domains are described in, for example, Zagotta W. N. et al, (1996) *Annual Rev. Neurosci.* 19: 235-263, the contents of which are incorporated herein by reference. Amino acid residues 758-774, 856-876, 923-941, 957-974, 1000-1016, and 1071-1096 of the 18610 or TR-1 polypeptide comprise transmembrane domains. Accordingly, TR-1 polypeptides having at least 50-60% homology, preferably about 60-70%, more preferably about 70-80%, or about 80-90% homology with a transmembrane domain of human TR-1 are within the scope of the invention.

In another embodiment, a 18610 or TR-1 molecule of the present invention is identified based on the presence of at least one pore domain between the fifth and sixth transmembrane domains. As used herein, the term "pore domain" includes an overall hydrophobic amino acid sequence which is located between two transmembrane domains of a calcium channel protein, preferably transmembrane domains 5 and 6, and which is believed to be a major determinant of ion selectivity and channel activity in calcium channels. Pore domains are described in, for example Vannier et al. (1998) *J. Biol. Chem.* 273: 8675-8679 and Phillips, A. M. et al. (1992) *Neuron* 8, 631-642, the contents of which are incorporated herein by reference. TR-1 molecules having at least one pore domain are within the scope of the invention. A pore domain is found in the human TR-1 sequence (SEQ ID NO:64) at about residues 1036-1055.

In another embodiment, a TR-1 molecule of the present invention is identified based on the presence of at least one "transient receptor domain." As used herein, the term "transient receptor domain" includes a protein domain having an amino acid sequence of about 40-175 amino acid residues which serves to transport ions. Preferably, a transient receptor domain includes at least about 48 amino acid residues. To identify the presence of a transient receptor domain in a TR-1 protein, and make the determination that a protein of interest has a particular profile, the amino acid sequence of the protein may be searched against a database of known protein domains (e.g., the HMM database). The transient receptor domain (HMM) has been assigned the PFAM Accession PF02164. A search was performed against the HMM database resulting in the identification of three transient receptor domains in the amino acid sequence of human 18610 (SEQ ID NO:64) at about residues 699-747, 849-1016, and 1079-1137 of SEQ ID NO:64.

A description of the Pfam database can be found in Sonhammer et al. (1997) *Proteins* 28:405-420 and a detailed description of HMMs can be found, for example, in Gribskov et al. (1990) *Meth. Enzymol.* 183:146-159; Gribskov et al. (1987) *Proc. Natl. Acad. Sci. USA* 84:4355-4358; Krogh et al. (1994) *J. Mol. Biol.* 235:1501-1531; and Stultz et al. (1993) *Protein Sci.* 2:305-314, the contents of which are incorporated herein by reference.

In a preferred embodiment, the TR-1 molecules of the invention include at least one transmembrane domain, preferably six transmembrane domains, at least one pore domain, and/or at least one transient receptor domain.

Isolated polypeptides of the present invention, preferably 18610 or TR-1 polypeptides, have an amino acid sequence sufficiently identical to the amino acid sequence of SEQ ID NO:64 or are encoded by a nucleotide sequence sufficiently identical to SEQ ID NO:63 or 65. As used herein, the term "sufficiently identical" refers to a first amino acid or nucleotide sequence which contains a sufficient or minimum number of identical or equivalent (e.g., an amino acid residue which has a similar side chain) amino acid residues or nucleotides to a second amino acid or nucleotide sequence such that the first and second amino acid or nucleotide sequences share common structural domains or motifs and/or a common functional activity. For example, amino acid or nucleotide sequences which share common structural domains having at least 50%, 55%, 60%, 65%, 70%, 75%, 80%, 85%, 85%, 90%, 91%, 92%, 93%, 94%, 95%, 96%, 97%, 98%, 99% or more homology or identity across the amino acid sequences of the domains and contain at least one and preferably two structural domains or motifs, are defined herein as sufficiently identical. Furthermore, amino acid or nucleotide sequences which share at least 50%, 55%, 60%, 65%, 70%, 75%, 80%, 85%, 85%, 90%, 91%, 92%, 93%, 94%, 95%, 96%, 97%, 98%, 99% or more homology or identity and share a common functional activity are defined herein as sufficiently identical.

In a preferred embodiment, a TR-1 polypeptide includes at least one or more of the following domains: a transmembrane domain, and/or a pore domain, and/or a transient receptor domain, and has an amino acid sequence at least about 50%, 55%, 60%, 65%, 70%, 75%, 80%, 85%, 85%, 90%, 91%, 92%, 93%, 94%, 95%, 96%, 97%, 98%, 99% or more homologous or identical to the amino acid sequence of SEQ ID NO:64. In yet another preferred embodiment, a TR-1 polypeptide includes at least one or more of the following domains: a transmembrane domain, and/or a pore domain, and/or a transient receptor domain, and is encoded by a nucleic acid molecule having a nucleotide sequence which hybridizes under stringent hybridization conditions to a complement of a nucleic acid molecule comprising the nucleotide sequence of SEQ ID NO:63 or SEQ ID NO:65. In another preferred embodiment, a TR-1 polypeptide includes at least one or more of the following domains: a transmembrane domain, and/or a pore domain, and/or a transient receptor domain, and has a 18610 or TR-1 activity.

As used interchangeably herein, a "TR-1 activity", "biological activity of TR-1" or "functional activity of TR-1", refers to an activity exerted by a TR-1 polypeptide or nucleic acid molecule on a TR-1 responsive cell or tissue, or on a TR-1 polypeptide substrate, as determined in vivo, or in vitro, according to standard techniques. In one embodiment, a TR-1 activity is a direct activity, such as an association with a TR-1-target molecule. As used herein, a "substrate," "target molecule," or "binding partner" is a molecule with which a TR-1 polypeptide binds or interacts in nature, such that TR-1-mediated function is achieved. A TR-1 target molecule can be a non-TR-1 molecule or a TR-1 polypeptide or polypeptide of the present invention. In an exemplary embodiment, a TR-1 target molecule is a TR-1 ligand, e.g., a calcium channel ligand such as calcium. Alternatively, a TR-1 activity is an indirect activity, such as a cellular signaling activity mediated by interaction of the TR-1 polypeptide with a TR-1 ligand.

The biological activities of TR-1 are described herein. For example, the TR-1 polypeptides of the present invention can have one or more of the following activities: (1) modulate membrane excitability, (2) influence the resting potential of membranes, (3) modulate wave forms and frequencies of action potentials, (4) modulate thresholds of excitation, (5) modulate neurite outgrowth and synaptogenesis, (6) modulate signal transduction, (7) participate in nociception, and (8) bind and transport calcium ions.

The nucleotide sequence of the isolated human TR-1 cDNA and the predicted amino acid sequence of the human TR-1 polypeptide are shown in SEQ ID NOs:63 and 64, respectively.

Isolation of the Human 18610 or TR-1 cDNA

The invention is based, at least in part, on the discovery of a human gene encoding a novel polypeptide, referred to herein as either human 18610 or TR-1. The entire sequence of the human clone Fbh18610 was determined and found to contain an open reading frame termed human "18610" or "TR-1." The nucleotide sequence of the human 18610 gene, which is 7334 nucleotides in length, is set forth in the Sequence Listing as SEQ ID NO:63. The amino acid sequence of the human 18610 expression product is set forth in the Sequence Listing as SEQ ID NO:64. The 18610 polypeptide comprises about 1885 amino acids. The coding region (open reading frame) of SEQ ID NO:63 is set forth as SEQ ID NO:65.

Analysis of the Human 18610 or TR-1 Molecules

A search using the polypeptide sequence of SEQ ID NO:64 was performed against the HMM database in PFAM resulting in the identification of three potential transient receptor domains in the amino acid sequence of human TR-1 at about residues 699-747, 849-1016, and 1079-1137 of SEQ ID NO:64. A search also identified an ion transport protein domain in the amino acid sequence of human TR-1 (SEQ ID NO:64) at about amino acid residues 884-1096 and an AN1-like zinc finger domain at about residues 33-61 of SEQ ID NO:64.

The amino acid sequence of human TR-1 was analyzed using the program PSORT to predict the localization of the proteins within the cell. This program assesses the presence of different targeting and localization amino acid sequences within the query sequence. The results of the analyses show the likelihood of human 18610 or TR-1 (SEQ ID NO:64) being localized, for example, to the endoplasmic reticulum, the nucleus, and the plasma membrane.

A MEMSAT analysis of the polypeptide sequence of SEQ ID NO:64 was also performed, predicting eight potential transmembrane domains in the amino acid sequence of human 18610 or TR-1 (SEQ ID NO:64) at about residues 282-301, 507-524, 758-774, 856-876, 923-941, 957-974, 1000-1016, and 1127-1146 of SEQ ID NO:64. However, a structural, hydrophobicity, and antigenicity analysis resulted in the identification of six transmembrane domains (TM1-TM6) and one pore domain between transmembrane domains five and six. TM1 is at about residues 758-774 of SEQ ID NO:64, TM2 is at about residues 856-876 of SEQ ID NO:64, TM3 is at about residues 923-941 of SEQ ID NO:64, TM4 is at about residues 957-974 of SEQ ID NO:64, TM5 is at about residues 1000-1016 of SEQ ID NO:64, TM6 is at about residues 1071-1096 of SEQ ID NO:64, and the pore domain is at about residues 1036-1055 of the amino acid sequence set forth as SEQ ID NO:64.

Searches of the amino acid sequence of human 18610 were further performed against the Prosite database. These searches resulted in the identification in the amino acid sequence of human 18610 (SEQ ID NO:64) of a number of potential N-glycosylation sites at about residues 404-407, 550-553, 715-718, 805-808, 925-928, 1058-1061, 1485-1488, 1616-1619, 1794-1797, and 1870-1873 of SEQ ID NO:64, a number of potential cAMP and cGMP-dependent protein kinase phosphorylation sites at about residues 600-603, 754-757, 1493-1496, and 1521-1524 of SEQ ID NO:64, a number of potential kinase C phosphorylation sites at about residues 2-4, 12-14, 22-24, 103-105, 195-197, 318-320, 349-351, 523-525, 529-531, 547-549, 615-617, 697-699, 727-729, 836-838, 842-844, 1245-1247, 1410-1412, 1456-1458, 1491-1493, 1520-1522, 1547-1549, 1719-1721, 1871-1873, and 1880-1882 of SEQ ID NO:64, a number of potential casein kinase II phosphorylation sites at about residues 5-8, 12-15, 22-25, 87-90, 115-118, 299-302, 367-370, 406-409, 508-511, 593-596, 603-606, 675-678, 778-781, 795-798, 883-886, 1163-1166, 1191-1194, 1361-1364, 1413-1416, 1430-1433, 1524-1527, 1547-1550, 1576-1579, 1635-1638, 1652-1655, 1763-1766, 1779-1782, and 1871-1874 of SEQ ID NO:64, a number of potential tyrosine kinase phosphorylation sites at about residues 320-327, 1212-1220, and 1566-1574 of SEQ ID NO:64, a number of potential N-myristoylation sites at about residues 32-37, 99-104, 159-164, 174-179, 208-213, 317-322, 357-362, 402-407, 522-527, 940-945, 1293-1298, 1349-1354, 1385-1390, 1438-1443, 1556-1561, 1642-1647, 1734-1739, and 1790-1795 of SEQ ID NO:64, and an amidation site at about residues 597-600 of SEQ ID NO:64.

A search of the amino acid sequence of human 18610 (SEQ ID NO:64) was also performed against the ProDom database. The results of this search identified numerous matches against protein domains described as, for example, "receptor from F54D1.5 transient sequence," "melastatin FIS chromosome receptor MTR1 transmembrane," "melastatin receptor chromosome transmembrane transient potential related," "melastatin FIS receptor MTR1 transmembrane chromosome," "receptor channel potential transient NOMPC TRP2 2-beta 2-alpha," "receptor transient potential-related," "channel receptor calcium transient potential repeat vanilloid transmembrane ion transport," "kinase serine/threonine-protein, ATP-binding transferase," "kinase elongation serine/threonine-protein transferase factor-2 eukaryotic calcium/calmodulin-dependent repeat," "kinase receptor-like," and the like were identified.

Tissue Distribution of Human 18610 or TR-1 mRNA by PCR Analysis

The following describes the tissue distribution of human 18610 mRNA, as may be determined by Polymerase Chain Reaction (PCR) on cDNA libraries using oligonucleotide primers based on the human 18610 sequence. For in situ analysis, various tissues, e.g. tissues obtained from brain, are first frozen on dry ice.

Tissue Distribution of Human 18610 or TR-1 mRNA by TaqMan™ Analysis

This example describes the tissue distribution of human 18610 mRNA in a variety of cells and tissues, as determined using the TaqMan™ procedure.

A human tissue panel was tested revealing highest expression of human 18610 mRNA in the in Jurkat cells (T-cell leukemia cells) and K562 cells (chronic myeloid leukemia cells), indicating a role for 18610 in cellular proliferation, growth, differentiation, or migration disorders such as cancer.

Human 33217

The invention is based, at least in part, on the identification of a novel AMP binding enzyme, referred to herein as "33217". The human 33217 sequence (see SEQ ID NO:66), which is approximately 2846 nucleotides long including untranslated regions, contains a predicted methionine-initiated coding sequence of about 2058 nucleotides, including the termination codon (see SEQ ID NO:68). The coding sequence encodes a 685 amino acid protein (see SEQ ID NO:67).

Human 33217 contains the following regions or other structural features: an AMP-binding enzyme domain (PFAM Accession Number PF00501) located at about amino acid residues 144-585 of SEQ ID NO:67, which includes a predicted AMP-binding domain signature (PS00455) at about amino acids 295 to 306 of SEQ ID NO:67; two predicted N-glycosylation sites (PS00001) from about amino acids 359-362 and 608-611 of SEQ ID NO:67; one predicted glycosaminoglycan attachment site (PS00002) from about amino acids 56-59 of SEQ ID NO:67; one predicted cAMP/cGMP-dependent protein kinase phosphorylation site (PS00004) located at about amino acids 9-12 of SEQ ID NO:67; four predicted Protein Kinase C phosphorylation sites (PS00005) at about amino acids 101-103, 144-146, 207-209, and 646-648 of SEQ ID NO:67; seven predicted Casein Kinase II phosphorylation sites (PS00006) located at about amino acids 58-61, 69-72, 144-147, 208-211, 552-555, 579-582, and 667-670 of SEQ ID NO:67; fourteen predicted N-myristylation sites (PS00008) from about amino acids 23-28, 29-34, 44-49, 163-168, 191-196, 199-204, 224-229, 303-308, 328-333, 370-375, 405-410, 453-458, 462-467, and 510-515 of SEQ ID NO:67; and one predicted amidation site (PS00009) from about amino acids 227-230 of SEQ ID NO:67.

Polypeptides of the invention include fragments which include: all or part of a hydrophobic sequence, e.g., the sequence from about amino acid 30 to 40, from about 185 to 200, and from about 385 to 395 of SEQ ID NO:67; all or part of a hydrophilic sequence, e.g., the sequence of from about amino acid 85 to 100, from about 270 to 280, and from about 465 to 475 of SEQ ID NO:67.

For general information regarding PFAM identifiers, PS prefix and PF prefix domain identification numbers, refer to Sonnhammer et al. (1997) *Protein* 28:405-420.

The 33217 protein contains a significant number of structural characteristics in common with members of the AMP-binding enzyme family.

Acetyl-Coenzyme A (Ac-CoA) is an activated form of acetate that is involved in lipid biosynthesis, energy metabolism, and other normal processes in human cells. Ac-CoA can be generated by catabolism of glucose (e.g., through operation of the Krebs cycle) or fatty acids.

Ac-CoA is a starting material used in biosynthesis of cholesterol, fatty acids, lipids, and biochemical products derived from these (e.g., sterol and other hormones). Ac-CoA is made by ligation of an adenylate moiety (derived by cleaving a pyrophosphonate moiety from ATP) with the acetyl carboxyl group, and then by substituting a CoA moiety in place of the adenylate moiety. Overall, the net reaction is: acetate+ CoASH+ATP→Ac-CoA+AMP+PP$_i$. This reaction is catalyzed by an enzyme designated acetyl-CoA synthetase (ACS; EC 6.2.1.1; sometimes designated acetate-CoA ligase, acetate thiokinase, or acetyl-activating enzyme).

ACS enzymes are involved in lipid synthesis and energy generation. A cytosolic form of human ACS has been cloned, and an in vitro enzymatic assay of ACS activity has been described (Luong et al. (2000) *J. Biol. Chem.* 275:26458-26466). In yeast and bacteria, expression of ACS can be induced or enhanced by one or more of a decrease in oxygen partial pressure, an increase in intracellular cAMP concentration, and increased carbon flux through acetate-associated metabolic pathways (Kratzer et al. (1997) *Mol. Microbiol.* 26:631-641; Hiesinger et al. (1997) *FEBS Lett.* 415:16-20; Kumari et al. (2000) *J. Bacteriol.* 182:4173-4179). ACS is also up-regulated in developing plant seeds (Ke et al. (2000) *Plant Physiol.* 123:497-508).

The AMP-binding enzyme family of proteins is characterized by a common domain, an "AMP-binding enzyme domain," that permits the respective family members to act via and ATP-dependent covalent binding of AMP to their substrates.

A 33217 polypeptide can include a "AMP-binding enzyme domain" or regions homologous with a "AMP-binding enzyme domain."

As used herein, the term "AMP-binding enzyme domain" includes an amino acid sequence of about 250 to 600 amino acid residues in length and having a bit score for the alignment of the sequence to the AMP-binding enzyme domain profile (Pfam HMM) of at least 100. Preferably, a AMP-binding enzyme domain includes at least about 350 to 500 amino acids, more preferably about 400 to 475 amino acid residues, or about 430 to 450 amino acids and has a bit score for the alignment of the sequence to the AMP-binding enzyme domain (HMM) of at least 130, 150, 190 or greater. The AMP-binding enzyme domain (HMM) has been assigned the PFAM Accession Number PF00501. Preferably, a 33217 polypeptide includes an AMP-binding domain signature having the consensus sequence [LIVMFY]-x(2)-[STG]-[STAG]-G-[ST]-[STEI]-[SG]-x-[PASLIVM]-[KR] (SEQ ID NO:70). Preferably, a 33217 polypeptide contains the AMP-binding domain signature located at amino acids 295-306 of SEQ ID NO:67.

In a preferred embodiment 33217 polypeptide or protein has a "AMP-binding enzyme domain" or a region which includes at least about 350 to 500 more preferably about 400 to 475 or 430 to 450 amino acid residues and has at least about 50%, 60%, 70% 80% 90% 95%, 99%, or 100% homology with a "AMP-binding enzyme domain," e.g., the AMP-binding enzyme domain of human 33217 (e.g., residues 144 to 585 of SEQ ID NO:67).

To identify the presence of a "AMP-binding enzyme" domain in a 33217 protein sequence, and make the determination that a polypeptide or protein of interest has a particular profile, the amino acid sequence of the protein can be searched against the Pfam database of HMMs (e.g., the Pfam database, release 2.1) using the default parameters. For example, the hmmsf program, which is available as part of the HMMER package of search programs, is a family specific default program for MILPAT0063 and a score of 15 is the default threshold score for determining a hit. Alternatively, the threshold score for determining a hit can be lowered (e.g., to 8 bits). A description of the Pfam database can be found in Sonhammer et al. (1997) *Proteins* 28(3):405-420 and a detailed description of HMMs can be found, for example, in Gribskov et al. (1990) *Meth. Enzymol.* 183:146-159; Gribskov et al. (1987) *Proc. Natl. Acad. Sci. USA* 84:4355-4358; Krogh et al. (1994) *J. Mol. Biol.* 235:1501-1531; and Stultz et al. (1993) *Protein Sci.* 2:305-314, the contents of which are incorporated herein by reference. A search was performed against the HMM database resulting in the identification of a "AMP-binding enzyme" domain in the amino acid sequence of human 33217 at about residues 144 to 585 of SEQ ID NO:67. The identified AMP-binding enzyme domain is depicted in SEQ ID NO:69.

Human 33217 is predicted to be an acetyl-CoA synthetase enzyme (i.e., an acetyl-CoA ligase). Amino acid residues 205-404 of SEQ ID NO:67 align with amino acid residues 1034-1633 of a *Pseudomonas aeruginosa* acetyl-CoA synthetase (GENBANK™ Accession number AAG06956) with 58% sequence identity (117/200). The BLAST score for this alignment is 642 (297.1 bits). In addition, amino acid residues 412-623 of SEQ ID NO:67 align with amino acid residues 1658-2293 of the *Pseudomonas aeruginosa* enzyme.

Amino acid residues 75-420 of SEQ ID NO:67 align with amino acid residues 617-1654 of a *Tetrahymena pyriformis* acetyl-CoA synthetase (GENBANK™ Accession number BAA86907) with 47% sequence identity (163/346). The BLAST score for this alignment is 864 (398.8 bits). In addition, amino acid residues 438-554 of SEQ ID NO:67 align with amino acid residues 1706-2056 of the Tetrahymena pyriformis enzyme, and amino acid residues 567-612 of SEQ ID NO:67 align with amino acid residues 2090-2227 of the Tetrahymena pyriformis enzyme.

A 33217 family member can include an AMP-binding enzyme domain and at least one AMP-binding domain signature. Furthermore, a 33217 family member can include at least one, preferably two predicted N-glycosylation sites (PS00001); at least one predicted glycosaminoglycan attachment site (PS00002); at least one predicted cAMP/cGMP-dependent protein kinase phosphorylation site (PS00004); at least one, two, three, and preferably four predicted protein kinase C phosphorylation sites (PS00005); at least one, two, three, four, five, six, and preferably seven predicted casein kinase II phosphorylation sites (PS00006); and at least 1, 2, 3, 4, 5, 6, 7, 8, 9, 10, 11, 12, 13, and preferably 14 predicted N-myristylation sites (PS00008); and at least one predicted amidation site (PS00009).

As the 33217 polypeptides of the invention may modulate 33217-mediated activities, they may be useful as of for developing novel diagnostic and therapeutic agents for 33217-mediated or related disorders, as described below.

As used herein, a "33217 activity", "biological activity of 33217" or "functional activity of 33217", refers to an activity exerted by a 33217 protein, polypeptide or nucleic acid molecule. For example, a 33217 activity can be an activity exerted by 33217 in a physiological milieu on, e.g., a 33217-responsive cell or on a 33217 substrate, e.g., a protein substrate. A 33217 activity can be determined in vivo or in vitro. In one embodiment, a 33217 activity is a activity is a direct activity, such as acetyl-CoA ligase activity, e.g., acetyl-CoA synthetase activity (i.e., ligation of a CoA moiety with an acetate moiety coupled with removal of a pyrophosphate moiety from ATP; formation of acetyl-CoA from acetate and CoASH catalyzed by a 33217 protein, proceeding through formation of an acetyl-adenylate intermediate). A "target molecule" or "binding partner" is a molecule with which a 33217 protein binds or interacts in nature, e.g., an integral membrane protein. In an exemplary embodiment, 33217 is an enzyme that acts via an ATP-dependent binding of AMP to its substrate.

A 33217 activity can also be an indirect activity, e.g., a cellular signaling activity mediated by interaction of the 33217 protein with a 33217 receptor. The features of the 33217 molecules of the present invention can provide similar biological activities as AMP-binding enzyme family members. For example, the 33217 proteins of the present invention can have one or more of the following activities: (1) acetyl-CoA ligase activity; (2) promotion of activation of acetate; (3) promotion of acetate utilization (4) enhancement of uptake of acetate into fatty acids and biochemical products made from fatty acids (e.g., lipids and hormones such as sterol hormones); (5) promoting angiogenesis; (6) enhancing or inducing expression of genes involved in angiogenesis; (7) enhancing tumor growth; (8) enhancing tumor cell survival; (9) inducing neo-angiogenesis; (10) inducing aberrant angiogenesis; (11) inducing tumorigenesis; (12) enhancing tumor cell metastasis; (13) enhancing tumor cell invasivity; or (14) agonizing or antagonizing one or more of (1)-(13).

The 33217 polypeptide is predicted to be a soluble protein that displays enzymatic activity. The 33217 polypeptide is likely to be localized in the cytosol of human cells, although it can also be localized within mitochondria. 33217 is expressed in several types of tumor cells and is expressed at a significantly lower level (or is not expressed) in the corresponding normal tissue. For example, 33217 is expressed in many tumor cells of glioblastomas (i.e., a type of brain tumor), but is expressed at a significantly lower level in normal brain cells. Similarly, 33217 is expressed in tumor cells of papillary serous ovarian tumors, but is expressed at a significantly lower level in normal ovarian cells. 33217 is also expressed in tumor cells of small cell lung tumors, but is expressed at a significantly lower level in normal lung cells and, apparently, in lung tumor cells of other types (e.g., non-small cell lung tumor cells).

Expression of 33217 correlates with expression of angiogenic factors, including VEGF, IL-8, Id3, and HIF-1a (as described below). Co-regulation of 33217 and known angiogenic factors is an indication that 33217 is among the proteins involved in promoting angiogenesis. Up-regulation of 33217 in tumor cells is an indication that this protein is involved in angiogenesis associated with tumor growth and survival. Involvement of other ACS enzymes in cell cycling, metabolic carbon flux, and seed development in non-human organisms suggests that 33217 has a role in shifting the metabolism of normal cells to adjust to altered growth conditions (e.g., hypoxia, metabolic changes associated with one or more of tumorigenesis, tumor growth, tumor invasion of surrounding tissues, and metastasis). Together, these observations indicate that 33217 has a role in survival, growth, invasiveness, and metastasis of tumor cells. Modulation (e.g., decrease or increase) of 33217 expression can therefore modulate these disease processes, indicating therapeutic, diagnostic, prognostic, and preventive utility for the nucleic acids, polypeptides, and other 33217-associated molecules described in this disclosure.

The 33217 enzymatic activity is predicted to include acetyl-CoA ligase activity, i.e., formation of acetyl-CoA thioesters, which can be used for lipid biosynthesis (and biosynthesis of biochemicals made from fatty acids and lipids, such as cholesterol and hormones like the sterol hormones) or oxidized and used as a cellular energy source. In particular, 33217 is predicted to display acetyl-CoA synthetase activity.

Based on the above-described sequence similarities and functional characterizations, the 33217 molecules of the present invention are predicted to have similar biological activities as AMP-binding enzyme family members. Thus, the 33217 molecules can act as novel diagnostic targets and therapeutic agents for fatty acid metabolism disorders and for cellular proliferative and/or differentiative disorders.

Disorders which may be treated or diagnosed by methods described herein include, but are not limited to, adrenoleukodystrophy, hypocholesterolemia, hypercholesterolemia, and disorders associated with an accumulation in the liver of fibrous tissue, such as that resulting from an imbalance between production and degradation of the extracellular matrix accompanied by the collapse and condensation of preexisting fibers. The methods described herein can be used to diagnose or treat hepatocellular necrosis or injury induced by a wide variety of agents including processes which disturb homeostasis, such as an inflammatory process, tissue damage resulting from toxic injury or altered hepatic blood flow, and infections (e.g., bacterial, viral and parasitic). For example, the methods can be used for the early detection of hepatic injury, such as portal hypertension or hepatic fibrosis. In addition, the methods can be employed to detect liver fibrosis attributed to inborn errors of metabolism, for example, fibrosis resulting from a storage disorder such as Gaucher's disease (lipid abnormalities) or a glycogen storage disease, A1-antitrypsin deficiency; a disorder mediating the accumulation (e.g., storage) of an exogenous substance, for example, hemochromatosis (iron-overload syndrome) and copper storage diseases (Wilson's disease), disorders resulting in the accumulation of a toxic metabolite (e.g., tyrosinemia, fructosemia and galactosemia) and peroxisomal disorders (e.g., Zellweger syndrome). Additionally, the methods described herein may be useful for the early detection and treatment of liver injury associated with the administration of various chemicals or drugs, such as for example, methotrexate, isonizaid, oxyphenisatin, methyldopa, chlorpromazine, tolbutamide or alcohol, or which represents a hepatic manifestation of a vascular disorder such as obstruction of either the intrahepatic or extrahepatic bile flow or an alteration in hepatic circulation resulting, for example, from chronic heart failure, veno-occlusive disease, portal vein thrombosis or Budd-Chiari syndrome.

Expression of 33217 was also detected in normal kidney, Wilm's tumor, uterine adenocarcinoma, fetal adrenal (very low), fetal kidney, fetal heart, normal heart, spinal cord, and lymphangioma tissues. Accordingly, 33217 nucleic acid sequences and fragments thereof, proteins encoded by these sequences and fragments thereof, as well as modulators of 33217 gene or protein activity can be useful in diagnosing or treating diseases that involve these tissues in which the 33217 is expressed.

Identification and Characterization of Human 33217 cDNA

The human 33217 sequence (SEQ ID NO:66) is approximately 2846 nucleotides long. The region between and inclusive of the initiation codon and the termination codon is a methionine-initiated coding sequence of about 2058 nucleotides, including the termination codon (nucleotides indicated as "coding" of SEQ ID NO:66; SEQ ID NO:68). The coding sequence encodes a 685 amino acid protein (SEQ ID NO:67).

Tissue Distribution of 33217 mRNA by TaqMan Analysis

Endogenous human 33217 gene expression was determined using the Perkin-Elmer/ABI 7700 Sequence Detection System which employs TaqMan technology.

To determine the level of 33217 in various human tissues a primer/probe set was designed. Total RNA was prepared from a series of cell lines or human tissues using an RNeasy kit from Qiagen. First strand cDNA was prepared from 1 µg total RNA using an oligo-dT primer and Superscript II reverse transcriptase (Gibco/BRL). cDNA obtained from approximately 50 ng total RNA was used per TaqMan reaction. Tissues tested include the human tissues and cell lines shown in Tables 42, 43, and 44.

As shown in Tables 42 and 43, expression of 33217 correlates with expression of angiogenic factors, including VEGF, IL-8, Id3, and HIF-1a. Co-regulation of 33217 and angiogenic factors is an indication that 33217 participates in angiogenic processes.

TABLE 42

Co-Regulation of Expression of 33217 and Angiogenic Factors In Normal Brain and Glioblastoma Samples

| Gene | Relative Expression in Normal Brains | Relative Expression in Glioblastomas |
|---|---|---|
| 33217 | 1.0 | 2.5 |
| IL-8 | 1.0 | 3.3 |
| Id3 | 1.0 | 3.4 |
| HIF-1a | 1.0 | 5.7 |

TABLE 43

Co-Regulation of 33217 and VEGF-C In Normal Brain and Glioblastoma Samples

| Type of Brain Tissue Sample | Sample Designation | Relative Expression of 33217 | Relative Expression of VEGF-C |
|---|---|---|---|
| Normal Brain | MCL03 | 1.00 | 1.00 |
| Normal Brain | MCL04 | 1.33 | 1.47 |
| Normal Brain | MCL06 | 2.26 | 3.69 |
| Glioblastoma | CHT201 | 2.27 | 3.10 |
| Glioblastoma | CHT216 | 2.40 | 3.16 |
| Glioblastoma | CHT501 | 3.39 | 4.90 |

As shown in Table 44, expression of 33217 is highly elevated in some lung tumor samples, as compared to normal lung tissue samples.

TABLE 44

Expression of 33217 in Normal Lung and Lung Tumors

| Type of Lung Tissue Sample | Relative Expression of 33217 |
|---|---|
| Normal | 0.7 |
| Normal | 0.7 |
| Normal | 1.0 |
| Normal | 0.3 |
| Tumor | 0.2 |
| Tumor | 11.4 |
| Tumor | 0.8 |
| Tumor | 0.4 |
| Tumor | 10.6 |
| Tumor | 0.2 |
| Tumor | 1.1 |

Human 21967

The present invention is based, at least in part, on the discovery of novel molecules, referred to herein as Lysyl Oxidase Related-2 ("Lor-2") molecules, "Lor-2" or "21967" nucleic acid and polypeptide molecules, which play a role in or function in a variety of cellular processes in the cardiovascular system, e.g., cardiac cell function. In another embodiment, the Lor-2 molecules of the present invention modulate the activity of one or more proteins involved in a cardiovascular disorder, e.g., congestive heart failure, ischemia, cardiac hypertrophy, ischemic-reperfusion injury.

As used herein, the term "cardiovascular disorder" includes a disease, disorder, or state involving the cardiovascular system, e.g., the heart, the blood vessels, and/or the blood. A cardiovascular disorder can be caused by an imbalance in arterial pressure, a malfunction of the heart, or an occlusion of a blood vessel, e.g., by a thrombus. Examples of such disorders include hypertension, atherosclerosis, coronary artery spasm, coronary artery disease, valvular disease, arrhythmias, and cardiomyopathies.

As used herein, the term "congestive heart failure" includes a condition characterized by a diminished capacity of the heart to supply the oxygen demands of the body. Symptoms and signs of congestive heart failure include diminished blood flow to the various tissues of the body, accumulation of excess blood in the various organs, e.g., when the heart is unable to pump out the blood returned to it by the great veins, exertional dyspnea, fatigue, and/or peripheral edema, e.g., peripheral edema resulting from left ventricular dysfunction. Congestive heart failure may be acute or chronic. The manifestation of congestive heart failure usually occurs secondary to a variety of cardiac or systemic disorders that share a temporal or permanent loss of cardiac function. Examples of such disorders include hypertension, coronary artery disease, valvular disease, and cardiomyopathies, e.g., hypertrophic, dilative, or restrictive cardiomyopathies. Congestive heart failure is described in, for example, Cohn J. N. et al. (1998) *American Family Physician* 57:1901-04, the contents of which are incorporated herein by reference.

As used herein, the term "cardiac cellular processes" includes intra-cellular or inter-cellular processes involved in the functioning of the heart. Cellular processes involved in the nutrition and maintenance of the heart, the development of the heart, or the ability of the heart to pump blood to the rest of the body are intended to be covered by this term. Such processes include, for example, cardiac muscle contraction, distribution and transmission of electrical impulses, and cellular processes involved in the opening and closing of the cardiac valves. The term "cardiac cellular processes" further includes processes such as the transcription, translation and post-translational modification of proteins involved in the functioning of the heart, e.g., myofilament specific proteins, such as troponin I, troponin T, myosin light chain 1 (MLC1), and α-actinin.

Lysyl oxidase ("LOX") is an extracellular copper enzyme that initiates the crosslinking of collagens and elastin by catalyzing oxidative deamination of the ε-amino group in certain lysine and hydroxylysine residues of collagens and lysine residues of elastin (Smith-Mungo and Kagan (1998) *Matrix Biol.* 16:387-398 and Kaman in *Biology of Extracellular Matrix*, ed. Mecham (1986) *Academic Press* pp. 321-389). Lysyl oxidase has been shown to be important in a variety of cellular and physiologic processes including biogenesis of connective tissue matrices and bone resorption. A deficiency in lysyl oxidase activity is found in two X-linked, recessively inherited connective tissue disorders, the type IX variant of the Ehlers-Danlos syndrome and the Menkes syndrome, and in the X-linked, recessively inherited mottled series of allelic mutant mice (all characterized by abnormalities in copper metabolism). (Byers et al. (1980) *New Engl. J. Med.* 303:61-65; Royce et al. (1980) *Biochemistry J.* 192:579-586; Kuivaniemi et al. (1982) *J. Clin. Invest.* 69:730-733; Kuivaniemi et al. (1985) *Amer. J. Human. Genet.* 37:798-808; Peltonen et al. (1983) *Biochemistry* 22:6156-6163; Rowe et al. (1977) *J. Biol. Chem.* 252:939-942; Starcher et al. (1977) *Biochem. Biophys. Res. Commun.* 78:706-712; Danks in *The Metabolic Basis of Inherited Disease*", eds. Stanbury et al. (1983), *McGraw-Hill* pp. 1251-1268). Increased lysyl oxidase activity has been associated with fibrotic disorders such as atherosclerosis, hypertension, and liver and pulmonary fibrosis. (Kagan, supra).

More recently there have been identified proteins having structural and/or functional similarities to lysyl oxidase. For example, a lysyl oxidase-like protein, referred to herein as "LOL", was identified from a human skin fibroblast cDNA library that contains extensive homology to several coding domains within the human lysyl oxidase mRNA which is believed to be involved in collagen maturation. (Kenyon et al. (1993) *J. Biol. Chem.* 268:18435-18437 and Kim et al. (1995) *J. Biol. Chem.* 270:7176-7182). Recent cloning and analysis of the mouse LOL gene (Kim et al. (1999) *J. Cell Biochem.* 72:181-188) demonstrated that steady state levels of LOL mRNA and type III procollagen mRNA increased coincidentally early in the development of liver fibrosis. In contrast, steady state levels of lysyl oxidase mRNA increased throughout the onset of hepatic fibrosis and appeared in parallel with the increased steady state levels of pro-alpha (I) collagen mRNA, suggesting that the LOL protein is involved in the development of lysine-derived cross-links in collagenous substrates. Moreover, the substrate specificity of the LOL protein may be different to that of lysyl oxidase and this difference may be collagen-type specific.

Likewise, a protein referred to herein as lysyl-oxidase related protein ("Lor") has been identified which inhibits many of the structural features of lysyl oxidase and is overexpressed in senescent fibroblasts and is believed to play a role in age-associated changes in extracellular proteins. (Saito et al. (1997) *J. Biol. Chem.* 272:8157-8160). Lor contains four domains referred to herein as scavenger receptor cysteine-rich domains ("SRCR domains") which are believed to be involved in binding to other cell surface proteins or extracellular molecules. The SRCR domain joins a long list of other widely distributed cysteine-containing domains found in extracellular portions of membrane proteins and in secreted proteins (Doolittle (1985) *Trends Biochem. Sci.* 10:233-237; Krieger in *Molecular Structures of Receptors*, eds. Rossow et al. (1986) *Horwood, Chichester, U.K.* pp. 210-231). Examples include the EGF-like domain, immunoglobulin superfamily domains, the LDL receptor/complement. C9 domain, clotting factor Kringle domains, and fibronectin domains. These disulfide cross-linked domains appear to provide stable core structures that (i) are able to withstand the rigors of the extracellular environment; (ii) are well suited for a variety of biochemical tasks, often involving binding; and (iii) are readily juxtaposed to other types of domains to permit the construction of complex mosaic proteins. (Doolittle supra; Sudhof et al. (1985) *Science* 228:815-822).

Lysyl oxidases ("LOXs") have been immunolocalized to the extracellular matrix regions of stroma surrounding early breast cancers (Decitre et al. (1998) *Lab Invest* 78:143-151), with decreased expression observed in the stroma surrounding invasive breast cancers (Peyrol et al. (1997) *Am. J. Pathol.* 150:497-507). A progressive loss of LOX expression has also been observed during prostate cancer progression in mice (Ren et al. (1998) *Cancer Res.* 58:1285-1290). These observations suggest that lysyl oxidases may function as tumor suppressors.

It has further been shown that human Lor is highly expressed in all adherent tumor cell lines examined, but not in cell lines that grow in suspension (Saito et al., supra), suggesting that LOXs can increase the adhesion properties of tumor cells. Lor expression was demonstrated to be concomitant with upregulation of type I procollagen. As adhesion properties contribute to the ability of tumor cells to colonize new sites, a tumor-promoting role for LOXs is also probable.

One embodiment of the invention features Lor-2 nucleic acid molecules, preferably human Lor-2 molecules, which were identified from a cDNA library made from the heart of a patient with congestive heart failure (CHF). The Lor-2 nucleic acid and protein molecules of the invention are described in further detail in the following subsections.

In yet another embodiment, the isolated proteins of the present invention, preferably Lor-2 proteins, can be identified based on the presence at least one SRCR domain and/or a lysyl oxidase domain and/or and a signal sequence.

In a preferred embodiment, a Lor-2 family member includes at least 1, 2, 3, 4, or more scavenger receptor cysteine-rich ("SRCR") domains. Scavenger receptors are proteins which have been implicated in the development of atherosclerosis and other macrophage-associated functions. For example, the type I mammalian macrophage scavenger receptors are membrane glycoproteins implicated in the pathologic deposition of cholesterol in arterial walls during atherogenesis (Freeman et al. (1990) *Proc. Natl. Acad. Sci.*

U.S.A. 87:8810-8814). Scavenger receptors are characterized by the presence of a cysteine-rich domain, which is proposed to be involved in binding of physiological ligands (e.g., cell-surface proteins). This cysteine rich domain is referred to herein and in the art as a scavenger receptor cysteine-rich ("SRCR") domains. Intra- or intercellular binding of ligand to the SRCR domain is believed to play a role in signaling or adhesion As defined herein, a SRCR domain includes a protein domain which is about 88-112 amino acid residues in length and has about 16-60% identity with a SRCR of type I human macrophage scavenger receptor (e.g., amino acid residues 353-450 of SEQ ID NO:80). In another embodiment, a SRCR is abuse 90-110, 92-108, 94-106, or 95, 96, 97, 98, 99, 100, 101, 102, 103, 104, 105, or 106 amino acid residues in length and has about 22-54%, 26-50%, 28-48%, or 29%, 30%, 31%, 32%, 33%, 34%, 35%, 36%, 37%, 38%, 39%, 40%, 41%, 42%, 43%, 44%, 45%, 46%, or 47% identity with a SRCR of type I human macrophage scavenger receptor (e.g., amino acid residues 353-450 of SEQ ID NO:80). For example, a SRCR domain can be found in murine type I scavenger receptor (Accession No. 1709140) from about amino acid residues 360-457. SRCR domains also have been found in diverse secreted and other cell-surface proteins from humans (e.g., CD5 and complement factor I), mice (Ly-1), and sea urchins (speract receptor). Moreover, many proteins include more than one SRCR domain (e.g., Ly-1 includes 3 SRCR domains and the speract receptor includes 4 SRCR domains). Likewise, human Lor-2 includes 4 SRCR domains, as set forth below.

To identify the presence of an SRCR in a Lor-2 family member, the amino acid sequence of the protein family member can be searched against a database of HMMs (e.g., the Pfam database, release 3.3) e.g., using the default parameters. For example, the search can be performed using the hmmsf program (family specific) and threshold score of 15 for determining a hit. hmmsf is available as part of the HMMER package of search programs (HMMER 2.1.1, Dec. 1998) which is freely distributed by the Washington University school of medicine. In one embodiment, a hit to a SRCR HMM having a score of at least 30-40, preferably at least 50-60, more preferably at least 70-80, and more preferably at least 90 or more is determinative of the presence of a SRCR domain within a query protein. A search using the amino acid sequence of SEQ ID NO:72 was performed against the HMM database resulting in the identification of 4 SRCR domains in the amino acid sequence of SEQ ID NO:72. Accordingly, in one embodiment of the invention, a Lor-2 protein has an SRCR domain at about amino acids 51-145 of SEQ ID NO:72. (Score of 91.4 against the SRCR domain profile HMM Accession No. PF00530). In another embodiment, a Lor-2 protein has an SRCR domain at about amino acids 183-282 of SEQ ID NO:72. (Score of 35.8). In another embodiment, a Lor-2 protein has an SRCR domain at about amino acids 310-407 of SEQ ID NO:72. (Score of 128.9). In another embodiment, a Lor-2 protein has an SRCR domain at about amino acids 420-525 of SEQ ID NO:72. (Score of 55.2).

Lor-2 family members can further include at least one or more speract receptor repeated domain ("SRRD") signatures. The speract receptor is a transmembrane glycoprotein of 500 amino acid residues (Dangott et al. (1989) PNAS U.S.A. 86:2128-2132) which consists of a large extracellular domain of 450 which contains four repeats of a ~115 amino acids termed more speract receptor repeated domain or "SRRDs". Multiple sequence alignment of the four repeats reveals at least 17 perfectly conserved residues (including six cysteines, six glycines, and three glutamates). A SRRD signature has been generated from an alignment of the four SRRDs and has the consensus sequence: G-x(5)-G-x(2)-E-x(6)-W-G-x(2)-C-x(3)-[FYW]-x(8)-C-x(3)-G, corresponding to SEQ ID NO:74. The SRRD signature is further described in PROSITE Document, Accession No. PDOC00348 and as PROSITE Accession No. PS00420. In one embodiment, a SRRD signature is included within a SRCR. For example, a SRRD can be found in a SRCR of the C-terminal section of the mammalian macrophage scavenger receptor type I (Freeman et al. (1990) PNAS U.S.A. 87:8810-8814). Likewise, a SRRD signature can be found within the SRCR domain of human Lor-2 from about amino acids 312-349 of SEQ ID NO:72.

The consensus sequences herein are described according to standard Prosite Signature designation (e.g., all amino acids are indicated according to their universal single letter designation; X designates any amino acid; X(n) designates any n amino acids, e.g., X (2) designates any 2 amino acids; [FYW] indicates any one of the amino acids appearing within the brackets, e.g., any one of F, Y, or W, in the alternative, any one of Phe, Tyr, or Trp; and {X} indicates any amino but the amino acid included within the brackets.)

Lor-2 family members can further include at least one domain characteristic of lysyl oxidase, referred to herein as a lysyl oxidase domain or "LOX domain". Lysyl oxidase is an extracellular copper-dependent enzyme that catalyzes the oxidative deamination of peptidyl lysine residues in precursors of various collagens and elastins. The deaminated lysines are then able to form aldehyde cross-links. (Krebs et al. (1993) Biochem. Biophys. Acta. 1202:7-12). The amino acid sequence of lysyl oxidase includes a signal sequence (e.g., amino acids 1 to 21 of human lysyl oxidase set forth as SEQ ID NO:75, a pro-peptide region (e.g., amino acids 22 to 168 of SEQ ID NO:75), and a region corresponding to the active, processed protein (e.g., amino acids 169-417 of SEQ ID NO:75), which is responsible for the enzymatic function of the molecule. Lysyl oxidase can be further characterized by the presence of a copper-binding site (Krebs et al. (1993) Biochem. Biophys. Acta. 12-2:7-12) having four conserved histidine residues that presumably supply the nitrogen ligands for copper coordination, and a quinone cofactor binding site (Wang et al. (1996) Science 273:1078-1084) (e.g., his289, his292, his294, and his296 of SEQ ID NO:75), also referred to as a "copper talon". The copper binding site of human Lor-2 can be found, for example, at about amino acids 286-296 of SEQ ID NO:75.

Accordingly, as used herein, the term "LOX domain" includes a protein domain which is about 245-275 amino acid residues in length, and has about 38-64% identity with the amino acid sequence of processed lysyl oxidase (e.g., amino acid residues 169-417 of SEQ ID NO:75). Preferably, a LOX domain is about 225-300, more preferably about 230-290 amino acid residues in length, and more preferably about 235-285, or 240-280 amino acid residues in length, and has about 34-65% identity, preferably about 42-62%, and more preferably about 46-56% or 50-52% identity with the amino acid sequence of processed lysyl oxidase (e.g., amino acid residues 169-417 of SEQ ID NO:75). For example, a LOX domain can be found in huLOL (SEQ ID NO:76) from about amino acids 310-574; in huLor (SEQ ID NO:77) from about amino acids 481-751; in mu Lor-2 (SEQ ID NO:78) from about amino acids 464-733; and in huLor-2 (SEQ ID NO:72) from about amino acids 463-732.

In another embodiment, a LOX domain is involved in a lysyl oxidase or lysyl oxidase-like function. Lysyl oxidase or lysyl oxidase-like functions include, for example, aminotransferase activity, peptidyl lysine oxidation, oxidative deamination of lysine, cross-linking of extracellular matrix components, copper binding, and/or copper metabolism. Lysyl oxidase or lysyl oxidase-like functions are described in detail, for example, in Kagan et al. in *Catalytic Properties and structural components of lysyl oxidase*, John Wiley & Sons (1995) pp. 100-121, the contents of which are incorporated herein by reference. In yet another embodiment, a LOX domain has at least one, preferably two, and more preferably three or four histidine residues corresponding to the conserved histidine residues of lysyl oxidase which are involved in copper binding. For example, a LOX domain of a human Lor-2 sequence set forth in SEQ ID NO:72 (e.g., amino acid residues 330-732 in SEQ ID NO:72) has four histidine residues (e.g., his604, his607, his609, and his611 of SEQ ID NO:72) which correspond to those of human lysyl oxidase set forth as SEQ ID NO:75.

A LOX domain in a protein can further be included within a lysyl oxidase-related region ("LOX-related region"). A LOX-related region within a protein (e.g., within a Lor-2 family member) includes a protein region which is about 380-580, preferably about 390-550, more preferably about 400, 420, 450 or 500 amino acid residues in length and has at least 30-35%, 40-45%, 50-55%, 60-65%, 70-75%, 80-85%, or 90-95% homology with, for example, the amino acid sequence of human LOX. To identify the presence of a LOX-related region in a Lor-2 family member, the amino acid sequence of the protein family member can be searched against the HMM database, as described previously. In one embodiment, a hit to a LOX HMM having a score of at least 100-110, preferably at least 120-130, more preferably at least 140-150, and more preferably at least 160 or more is determinative of the presence of a LOX-related region within a query protein. A search using the amino acid sequence of SEQ ID NO:72 was performed against the HMM database resulting a hit to a LOX HMM from about amino acids 330-732 of SEQ ID NO:72. (Score of 166.6 against the LOX domain profile HMM Accession No. PF01186). Similar LOX-related regions were identified in muLor-2 from about amino acids 318-733 of SEQ ID NO:78 (Score of 162.8), in huLOL from about amino acids 1-574 of SEQ ID NO:76 (Score of 382.2) and in huLor from about amino acids 358-751 of SEQ ID NO:77 (Score of 146.8). In yet another embodiment, a lysyl oxidase-related region has at least 40-45%, 50-55%, 60-65%, 70-75%, 80-85%, or 90-95% homology with the amino acid sequence of a LOX domain of a human Lor-2 sequence set forth in SEQ ID NO:72 (e.g., amino acid residues 330-732 in SEQ ID NO:72). The lysyl oxidase-related regions of huLOL, huLor, muLor-2 and huLor-2 are the amino acids corresponding to processed lysyl oxidase (e.g., amino acids 169-417 of SEQ ID NO:75).

Another embodiment of the invention features a protein of the invention, preferably a Lor-2 protein, which contains a signal sequence. As used herein, a "signal sequence" refers to a peptide containing about 25 amino acids which occurs at the N-terminus of secretory proteins and which contains a large number of hydrophobic amino acid residues. For example, a signal sequence contains at least about 17-33 amino acid residues, preferably about 20-30 amino acid residues, more preferably about 24-26 amino acid residues, and more preferably about 25 amino acid residues, and has at least about 35-65%, preferably about 38-50%, and more preferably about 40-45% hydrophobic amino acid residues (e.g., Valine, Leucine, Isoleucine or Phenylalanine). Such a "signal sequence", also referred to in the art as a "signal peptide", serves to direct a protein containing such a sequence to a lipid bilayer. For example, in one embodiment, a Lor-2 protein contains a signal sequence containing about amino acids 1-25 of SEQ ID NO:72.

In yet another embodiment, a protein of the invention, preferably a Lor-2 protein, encodes a mature protein. As used herein, the term "mature protein" refers to a protein of the invention, preferably a Lor-2 protein, from which the signal peptide has been cleaved. In an exemplary embodiment, a mature Lor-2 protein contains amino acid residues 26 to 753 of SEQ ID NO:72.

In yet another embodiment, Lor-2 family members include at least 1, 2, 3, 4, 5 or more N-glycosylation sites. Predicted N-glycosylation sites are found, for example, from about amino acid 111-114, 266-269, 390-393, 481-484, and 625-628 of SEQ ID NO:72.

Lor-2 family members can further include at least 1, 2, 3, 4, 5, 6, 7, 8, or more or more Protein kinase C ("PKC") phosphorylation sites. Predicted PKC phosphorylation sites are found, for example, from about amino acid 97-99, 104-106, 221-223, 268-270, 352-354, 510-512, 564-566, and 649-651 of SEQ ID NO:72.

Lor-2 family members can further include at least 1, 2, 3, 4, 5, 6, 7, 8, 9, 10, 11, 12, 13, 14, or more Casein kinase II phosphorylation sites. Predicted casein kinase II phosphorylation sites are found, for example, from about amino acid 31-34, 68-71, 115-118, 120-123, 135-138, 330-333, 352-355, 377-380, 392-395, 411-414, 424-427, 493-496, 527-530, and 617-620 of SEQ ID NO:72.

Lor-2 family members can further include at least 1, 2, 3, 4, 5, 6, 7, 8, 9, 10, 11, 12, 13, 14, 15, 16, 17, 18, 19, or more N-myristoylation sites. Predicted N-myristoylation sites are found, for example, from about amino acids 13-18, 116-121, 130-135, 273-278, 312-317, 359-364, 378-383, 403-408, 443-448, 451-456, 463-468, 470-475, 489-494, 506-511, 515-520, 521-526, 626-631, 661-666, and 746-751 of SEQ ID NO:72.

Lor-2 family members can further include at least one or more amidation sites. A predicted amidation site is found, for example, from amino acid 117-180 of SEQ ID NO:72. As used herein, the site(s) have a consensus sequence selected from: N-{P}-[ST]-{P}(SEQ ID NO:83), where N is a glycosylation site (see PROSITE document PS00001); [ST]-X—[RK] (SEQ ID NO:84), where S or T is a phosphorylation site (see PROSITE document PS00005); [ST]-X (2)-[DE] (SEQ ID NO:85), where S or T is a phosphorylation site (see PROSITE document PS00006); G-{EDRKHPFYW}-X (2)-[STAGCN]-{P}(SEQ ID NO:86), where G is an N-myristoylation site (see PROSITE Accession No. PS00008); and X-G-[RK]-[RK] (SEQ ID NO:87), where X is an amidation site (see PROSITE document PS00009). These sites are further described at the expasy website as PDOC00001, PDOC00005, PDOC00006, PDOC00008, and PS00009, respectively.

Isolated proteins of the present invention, preferably Lor-2 proteins, have an amino acid sequence sufficiently homologous to the amino acid sequence of SEQ ID NO:72 or are encoded by a nucleotide sequence which includes a nucleotide sequence sufficiently homologous to SEQ ID NO:71. As used herein, the term "sufficiently homologous" includes a first amino acid or nucleotide sequence which contains at least a minimum number of identical or equivalent (e.g., an amino acid residue which has a similar side chain) amino acid residues or nucleotides to a second amino acid or nucleotide sequence such that the first and second amino acid or nucleotide sequences share common structural domains or motifs and/or a common functional activity. For example, amino acid or nucleotide sequences which share common structural domains have at least 30%, 40% or 50% homology, preferably 55%, 60%, 65%, 70% or 75% homology, more preferably 80%, 85%, 90%, 91%, 92%, 93%, 94%, 95%, 96%, 97%, 98% or 99% homology across the amino acid sequences of the domains and contain at least one and preferably two structural domains or motifs, are defined herein as sufficiently homologous. Furthermore, amino acid or nucleotide sequences which share at least 30%, 40% or 50% homology, preferably 55%, 60%, 65%, 70% or 75% homology, more preferably 80%, 85%, 90%, 91%, 92%, 93%, 94%, 95%, 96%, 97%, 98% or 99% homology and share a common functional activity are defined herein as sufficiently homologous.

Accordingly, another embodiment of the invention features isolated Lor-2 proteins and polypeptides having a Lor-2 activity. Preferred proteins are Lor-2 proteins having at least a signal sequence, a LOX domain, and at least one SRRD signature. Other preferred proteins are Lor-2 proteins having at least two, three, or four SRRD signatures. Other preferred proteins are Lor-2 proteins having at least a signal sequence, a LOX domain, and a SRCR domain. Other preferred proteins are Lor-2 proteins having at least a signal sequence, a LOX domain, and at least two SCRC domains. Other preferred proteins are Lor-2 proteins having at least a signal sequence, a LOX domain, and at least three SCRC domains. Other preferred proteins are Lor-2 proteins having at least a signal sequence, a LOX domain, and at least four SCRC domains.

The nucleotide sequence of the isolated human Lor-2 cDNA and the predicted amino acid sequence of the human Lor-2 polypeptide are shown in SEQ ID NOs:71 and 72, respectively.

The human Lor-2 cDNA (set forth in SEQ ID NO:71), which is approximately 2920 nucleotides in length, encodes a protein having a molecular weight of approximately 83.166 kD (with signal sequence) and 80.404 kD (without signal sequence) and which is approximately 753 (with signal sequence) (SEQ ID NO:72) and 728 amino acid residues (without signal sequence) in length. An ~3.0 kb Lor-2 message was found to be expressed most tissues tested but was most highly expressed in heart and placenta (at least heart, brain, placenta, lung, liver, skeletal muscle, kidney, and pancreas tissues were tested). High expression of Lor-2 was also observed in the G361 melanoma cell line and in the SW480 adenocarcinoma colon cell line (at least G361, SW480, HL60, Hela 53, K562, Molty, Raji, and A549 cell lines were tested).

In a preferred embodiment, Lor-2 proteins of the invention have an amino acid sequence of at least 600-900, preferably about 650-850, more preferably about 700-800, and even more preferably about 720-760, 728 or 753 amino acid residues in length.

As used interchangeably herein, a "Lor-2 activity", "biological activity of Lor-2" or "functional activity of Lor-2", includes an activity exerted by a Lor-2 protein, polypeptide or nucleic acid molecule as determined in vivo, in vitro, or in situ, according to standard techniques. In one embodiment, a Lor-2 activity is a direct activity, such as an association with a Lor-2-target molecule. As used herein, a "target molecule" is a molecule with which a Lor-2 protein binds or interacts in nature, such that Lor-2-mediated function is achieved. A Lor-2 target molecule can be a Lor-2 protein or polypeptide of the present invention or a non-Lor-2 molecule. For example, a Lor-2 target molecule can be a non-Lor-2 protein molecule. Alternatively, a Lor-2 activity is an indirect activity, such as an activity mediated by interaction of the Lor-2 protein with a Lor-2 target molecule such that the target molecule modulates a downstream cellular activity (e.g., interaction of a Lor-2 molecule with a Lor-2 target molecule can modulate the activity of that target molecule on a cardiac cell).

In a preferred embodiment, a Lor-2 activity is at least one or more of the following activities: (i) interaction of a Lor-2 protein with a Lor-2 target molecule; (ii) interaction of a Lor-2 protein with a Lor-2 target molecule, wherein the Lor-2 target is a ligand; (iii) interaction of a Lor-2 protein with a Lor-2 target molecule, wherein the Lor-2 target is an extracellular matrix component (e.g., collagen or elastin); and (iv) modification of a Lor-2 target molecule (e.g., posttranslational modification).

In yet another preferred embodiment, a Lor-2 activity is at least one or more of the following activities: (1) crosslinking an extracellular matrix component; (2) regulating bone resorption and/or metabolism; (3) regulating copper metabolism; (4) modulating maturation, stabilization and/or degradation of extracellular matrix components; (5) regulating cellular signaling; and (6) regulating cellular adhesion (e.g. adhesion of a tumor cell).

In another embodiment of the invention, a Lor-2 molecule or preferably, a Lor-2 modulator, is useful for regulating, preventing and/or treating at least one or more of the following diseases or disorders: (1) diseases or disorders involving impaired copper metabolism (e.g., type IX of the Ehlers-Danlos syndrome and the Menkes syndrome); (2) bone disorders (e.g., osteoporosis or osteoarthritis); (3) fibrotic disorders (e.g., atherosclerosis, tissue and/or organ fibrosis); (4) proliferative disorders (e.g., cancer, for example, prostate cancer, breast cancer, lung cancer and the like); (5) vascular disorders (e.g., ischemia, ischemic-reperfusion injury); and (6) cardiac trauma (e.g., iatrogenic, accidental).

In yet another embodiment of the invention, a Lor-2 molecule or preferably, a Lor-2 modulator, is useful for regulating, preventing and/or treating at least one or more of the following diseases or disorders: (1) cardiac hypertrophy and cardiomyopathy; (2) cardiac pathologies; (3) myocardial hypertrophy and cardiovascular lesions; (4) myocardial aneurysms; (5) atherosclerotic cardiovascular disease; (6) fibrotic disease; (7) osteoporosis; (8) metastasis/prostate cancer; (9) cellular senescence/tumor suppression; (10) tumor progression; (11) liver fibrosis; (12) wound healing; (13) hypertension; (14) diabetes; (15) arthritis; and (16) bone disease (e.g., osteoporosis or osteoarthritis).

In yet another embodiment, a Lor-2 modulator is useful for regulating (e.g., inhibiting) tumor progression. For example, Lor-2 may be secreted by a tumor cell facilitating adhesion (e.g., enhancing the adhesive properties) of the cell. Accordingly, Lor-2 modulators can be used to affect the adhesive properties of tumor cells (e.g., to surrounding tissues).

In yet another embodiment, a Lor-2 modulator, is useful for regulating or preventing immunosuppression by tumor cells. For example, Lor-2 may be secreted by a tumor cell, conferring on that cell a growth advantage (e.g., maintaining the growth, differentiation, and transformed phenotype of the tumor cell). In such a situation, secreted Lor-2 can inhibit cytoxicity (e.g., lymphocytotoxicity, for example, IL-2-induced lymphocytotoxicity). Accordingly, Lor-2 may function to suppress the generation and/or proliferation of lymphocytic cells (e.g., lymphocyte-activated killer cells).

Isolation of the Human 21967 or Lor-2 (i.e., Lysyl Oxidase Related-2) cDNA

The invention is based, at least in part, on the discovery of the human gene encoding 21967 or Lor-2. Human Lor-2 was isolated from a cDNA library which was prepared from tissue obtained from subjects suffering from congestive heart failure. Briefly, a cardiac tissue sample was obtained from a biopsy of a 42 year old woman suffering from congestive heart failure. mRNA was isolated from the cardiac tissue and a cDNA library was prepared therefrom using art-known methods (described in, for example, *Molecular Cloning A Laboratory Manual,* 2nd Ed., ed. by Sambrook, Fritsch and Maniatis (Cold Spring Harbor Laboratory Press: 1989). Using a program which identifies the presence of signal peptides (Nielsen, H. et al. (1997) *Protein Engineering* 10:1-6) a positive clone was isolated.

The sequence of the positive clone was determined and found to contain an open reading frame. The nucleotide sequence encoding the human 21967 or Lor-2 protein comprises about 2920 nucleic acids, and has the nucleotide sequence set forth as SEQ ID NO:71. The open reading frame of 21967 is disclosed in SEQ ID NO:73. The protein encoded by this nucleic acid comprises about 753 amino acids, and has the amino acid sequence set forth as SEQ ID NO:72.

Analysis of Human 21967 or Lor-2

A BLAST search (Altschul et al. (1990) *J. Mol. Biol.* 215:403) of the nucleotide and protein sequences of human Lor-2 revealed that Lor-2 is similar to the following protein molecules: a human lysyl oxidase-related protein (Accession No. U89942) having approximately 56.9% identity over amino acids 33-752 of Lor-2 (SEQ ID NO:72); and a second murine lysyl-oxidase related protein; (Accession No. AF053368) having approximately 92.6% identity over amino acids 1-753, e.g., over the entire length) of Lor-2 (SEQ ID NO:72). (Identities were calculated using the ALIGN algorithm of Huang and Miller (1991) *Adv. Appl. Math.* 12:373-381).

The Lor-2 protein is predicted to have a signal peptide from amino acid residues 1-25 of SEQ ID NO:72. Accordingly, a mature Lor-2 protein is predicted to include amino acid residues 26-753 of SEQ ID NO:72. Lor-2 is also predicted to have 5 N-glycosylation sites, 8 protein kinase phosphorylation ("PKC") sites, 14 casein kinase II phosphorylation sites, 19 N-myristoylation sites, and 1 amidation site. Predicted N-glycosylation sites are found, for example, from about amino acid 111-114, 266-269, 390-393, 481-484, and 625-628 of SEQ ID NO:72. Predicted PKC phosphorylation sites are found, for example, from about amino acid 97-99, 104-106, 221-223, 268-270, 352-354, 510-512, 564-566, and 649-651 of SEQ ID NO:72. Predicted casein kinase II phosphorylation sites are found, for example, from about amino acid 31-34, 68-71, 115-118, 120-123, 135-138, 330-333, 352-355, 377-380, 392-395, 411-414, 424-427, 493-496, 527-530, and 617-620 of SEQ ID NO:72. Predicted N-myristoylation sites are found, for example, from about amino acids 13-18, 116-121, 130-135, 273-278, 312-317, 359-364, 378-383, 403-408, 443-448, 451-456, 463-468, 470-475, 489-494, 506-511, 515-520, 521-526, 626-631, 661-666, and 746-751 of SEQ ID NO:72. A predicted amidation site is found, for example, from amino acid 117-180 of SEQ ID NO:72.

Moreover, Lor-2 has a 4 scavenger receptor cysteine-rich domains from amino acid residues 51-145, 183-282, 310-407, and 420-525 of SEQ ID NO:72. The third scavenger receptor cysteine-rich domain includes a speract receptor repeated domain signature from amino acid residues 312-349 of SEQ ID NO:72. Lor-2 further has a lysyl oxidase domain from residues 330-732 of SEQ ID NO:72. Within the lysyl oxidase domain of Lor-2, there exists a fragment having significant homology to the lysyl oxidase putative copper-binding region, termed the "copper-binding talon". A prosite consensus pattern describing the copper-binding talon is as follows: W-E-W—H—S—C—H-Q-H—Y—H (SEQ ID NO:79) (see also PROSITE documentation PDOC00716 and Krebs and Krawetz (1993) *Biochem. Biophys. Acta* 1202:7-12). Amino acid residues 601-701 of human Lor-2 (SEQ ID NO:72) have ~73% identity with this consensus sequence (8/11 residues) including each of the four conserved histidines, three of which are believed to be copper ligands residing within an octahedral coordination complex of lysyl oxidase.

Analysis of primary and secondary protein structures of 21967 was performed as follows: alpha, beta turn and coil regions, Garnier-Robson algorithm (Garnier et al. (1978) *J Mol Biol* 120:97); alpha, beta, and turn regions, Chou-Fasman algorithm (Chou and Fasman (1978) *Adv in Enzymol Mol* 47:45-148); hydrophilicity and hydrophobicity plots, Kyte-Doolittle algorithm (Kyte and Doolittle (1982) *J Mol Biol* 157:105-132); alpha amphipathic and beta amphipathic regions, Eisenberg algorithm (Eisenberg et al. (1982) *Nature* 299:371-374); flexible regions, Karplus-Schulz algorithm (Karplus and Schulz (1985) *Naturwissens-Chafen* 72:212-213); antigenic index, Jameson-Wolf algorithm (Jameson and Wolf (1988) *CABIOS* 4:121-136); surface probability plot, Emini algorithm (Emini et al. (1985) *J Virol* 55:836-839).

Prediction of the Chromosomal Location of 21967 or Lor-2—Electronic Mapping

To predict the chromosomal location of Lor-2, the Lor-2 nucleotide sequence of SEQ ID NO:71 was used to query, using the BLASTN program (Altschul S. F. et al, (1990) *J. Mol. Biol.* 215: 403-410) with a word length of 12 and using the BLOSUM62 scoring matrix, a database of human nucleotide sequences originating from nucleotide molecules (e.g., EST sequences, STS sequences and the like) that have been mapped to the human genome. Nucleotide sequences which had been previously mapped to human chromosome 2 near the D2S145 marker (e.g., having Accession Nos. AA191602 and R55706) were found to have high sequence identity to portions of the Lor-2 nucleotide sequence (3' UTR sequence) indicating that Lor-2 maps to the same chromosomal location. Moreover, it is predicted that allelic variants of Lor-2 will map the same chromosomal location and species orthologs of Lor-2 will map to loci syntenic with the human Lor-2 locus.

Confirmation and Analysis of the Chromosomal Location of 21967 or Lor-2—PCR Mapping The hLor-2 gene was mapped to human chromosome 2 (i.e., 2p11-p13), which is syntenic to mouse chromosome 6, by PCR typing of the Genebridge (G4) radiation hybrid panel (Research Genetics, Inc., Huntsville, Ala.). Typing of the DNA and comparison to radiation hybrid map data at the Whitehead Institute Center for Genome Research (WICGR) tightly linked the hLor-2 gene to a region on human chromosome 2 between WI-5987 (13.9cR) and GCT1B4 (16.7cR).

The huLor-2 primers used in the PCR mapping studies were: forward—GCTTACCAAGAAACCCATGTCAGC (SEQ ID NO:81) and reverse—GGCAGTTAGTCAGGT-GCTGC (SEQ ID NO:82). The radiation hybrid mapping studies were performed as follows: PCR reactions of radiation hybrid panels, GeneBridge 4 (Research Genetics, Inc., Huntsville, Ala.) were assembled in duplicate using an automated PCR assembly program on a TECAN Genesis. Each reaction consisted of: 5 µl DNA template (10 ng/µl), 1.5 µl 10×PCR buffer, 1.2 µl dNTPs (2.5 mM), 1.15 µl forward primer (6.6 µM) 1.15 µl reverse primer (6.6 µM0, and 5 µl 1:75 platinum Taq. The reactions were thermocycled on a Perkin-Elmer 9600 for 95° C. 10 minutes (for the platinum Taq), [95° C. 40 sec, 52° C. 40 sec, 72° C., 50 sec] 35X, 72° C., 5 minutes, 4° C. hold. Resulting PCR products were run out on a 2% agarose gel and visualized on a UV light box.

The positive hybrids for the Genebridge 4 panel were submitted to the Whitehead Genome Center for placement in relation to a framework map.

Human Lor-2 mapped in close proximity to known genes including actin, gamma 2, smooth muscle, enteric ("ACTG2"), nucleolysin TIA1, semaphorin W ("SEMAW"), dysferlin ("DYSF"), docking protein 1 ("DOK1"), glutamine-fructose-6-phosphate transaminase 1 ("GFPT"), the KIAA0331 gene, deoxyguanosine kinase ("DGUOK"), the TSC501 gene, eukaryotic translation initiation factor 3, subunit 10 ("EIF3S1"), tachykinin receptor 1 ("TACR1"), tissue-type plasminogen activator ("PLAT") and dual specificity phosphatase 11 ("DUSP11"). Nearby disease mutations and/or loci include Alstrom syndrome ("ALMS1"), an autosomal recessively inherited syndrome characterized by retinal degeneration, obesity, diabetes mellitus, neurogenous deafness, hepatic dysfunction, and in some cases, late onset cardiomyopathy (see e.g., Alstrom et al. (1959) *Acta Psychiat. Neurol. Scand.* 34 (suppl. 129):1-35; Alter and Moshang (1993) *Am. J. Dis. Child.* 147:97-99; Awazu et al. (1997) *Am. J. Med. Genet.* 69:13-16; Aynaci et al. (1995) (*Letter*) *Clin. Genet.* 48:164-166; Charles et al. (1990) *J. Med. Genet.* 27:590-592; Cohen and Kisch (1994) *Israel J. Med. Sci.* 30:234-236; Collin et al. (1997) *Hum. Molec. Genet.* 6:213-219; Collin et al. (1999) (*Letter*) *Clin. Genet.* 55:61-62; Connolly et al. (1991) *Am. J. Med. Genet.* 40:421-424; Goldstein and Fialkow (1973) *Medicine* 52:53-71; Macari et al. (1998) *Hum. Genet.* 103:658-661; Marshall et al. (1997) *Am. J. Med. Genet.* 73:150-161; Michaud et al. (1996) *J. Pediat.* 128:225-229; Millay et al. (1986) *Am. J. Ophthal.* 102:482-490; Rudiger et al. (1985) *Hum. Genet.* 69:76-78; Russell-Eggitt et al. (1998) *Ophthalmology* 105:1274-1280; Tremblay et al. (1993) *Am. J. Ophthal.* 115:657-665; Warren et al. (1987) *Am. Heart J.* 114:1522-1524 and Weinstein et al. (1969) *New Eng. J. Med.* 281:969-977), orofacial cleft 2 ("OFC2") (see e.g., Carinci et al. (1995) (*Letter*) *Am. J. Hum. Genet.* 56:337-339; Pezzetti et al. (1998) *Genomics* 50:299-305 and Scapoli et al. (1997) *Genomics* 43:216-220) and Parkinsons disease 3 (see e.g., Di Rocco et al. (1996) *Adv. Neurol.* 69:3-11 and Gasser et al. (1998) *Nature Genet.* 18:262-265). Additional information regarding Alstrom syndrome, orofacial cleft 2 and Parkinson disease 3 can be found collected under Accession Nos. 203800, 602966 and 602404, respectively, in the Online Mendelian Inheritance in Man ("OMIM™") database, the contents of which are incorporated herein by reference.

Moreover, the syntenic location on mouse chromosome 6 is near ovarian teratoma susceptibility 1 ("Ots-1"), dysruption of corticosterone in adrenal cortex cells ("Cor"), brain protein 1 ("Brp1"), lymphocyte antigen 36 ("Ly36"), major liver protein 1 ("Lvp1"), cerebellar deficient folia ("cdf"), motor neuron degeneration 2 ("mnd2"), truncate ("tc") and faded ("fe"). Of particular interest are the Lor-2 neighbors Ots-1 and Cor, both of which a postulated to play a role in tumor susceptibility. The Ots-1 locus was identified by linkage analysis of female LT/Sv mice, a strain characterized by its abnormally high incidence of spontaneous ovarian teratomas, which are extremely rare for other mouse strains. Ots-1 was identified as the single major locus that increases the frequency of teratomas in a semidominant manner (Lee et al. (1997) *Cancer Res.* 57:590-593. Likewise, the cor locus was identified as being associated with a phenotype of the AJ mouse strain (a strain susceptible to many neoplasms and infectious agents, presumably due to a deficiency in the phophylactic activities of endogenous glucocorticoids (e.g., adrenalcortical corticosterone ("CS")) (Thaete et al. (1990) *Proc. Soc. Exp. Biol. Med.* 194:97-102). Accordingly, at least two loci in the near vicinity of mouse Lor-2 on chromosome 6 are associated with tumor susceptibility. Additional information regarding the Ots-1 and Cor loci can be found collected under Accession Nos. MGI:85864 and MGI:58993, respectively, in the Mouse Genomics Informatics database, the contents of which are incorporated herein by reference. Likewise, information regarding the cdf locus, the mnd2 locus and the mouse Lor-2 gene (i.e., the mouse ortholog of human Lor-2) can be found collected under Accession Nos. MGI:86274, MGI:97039 and MGI:1337004, respectively.

Tissue Distribution of 21967 or Lor-2 mRNA

Standard molecular biology methods (Sambrook, J., Fritsh, E. F., and Maniatis, T. *Molecular Cloning: A Laboratory Manual.* 2nd, ed., Cold Spring Harbor Laboratory, Cold Spring Harbor Laboratory Press, Cold Spring Harbor, N.Y., 1989) were used to construct cDNA libraries in plasmid vectors from multiple human tissues. Individual cDNA clones from each library were isolated and sequenced and their nucleotide sequences were input into a database. The Lor-2 nucleotide sequence of SEQ ID NO:71 was used to query the tissue-specific library cDNA clone nucleotide sequence database using the BLASTN program (Altschul S. F. et al, (1990) *J. Mol. Biol.* 215: 403-410) with a word length of 12 and using the BLOSUM62 scoring matrix. Nucleotide sequences identical to portions of the Lor-2 nucleotide sequence of SEQ ID NO:71 were found in cDNA libraries originating from human endothelial cells, lymph node, bone, heart, neuron, and testes. Lor-2 nucleic acid sequences, fragments thereof, proteins encoded by these sequences, and fragments thereof as well as modulators of Lor-2 gene or protein activity may be useful for diagnosing or treating diseases that involve the tissues in which the Lor-2 mRNA is expressed. Likewise, when a similar analysis was performed using the Lor-2 sequence of SEQ ID NO:71 to query publicly available nucleotide sequence databases (e.g., DBEST databases) using BLAST, sequences having high homology to the 3' untranslated region of human Lor-2 were identified in a Soares placenta normalized library and in Soares testis, B-cell and lung normalized libraries.

Northern blot hybridization with RNA samples was next performed under standard conditions and washed under stringent conditions, i.e., 0.2×SSC at 65° C. A DNA probe was radioactively labeled with $^{32}$P-dCTP using the Prime-It kit (Stratagene, La Jolla, Calif.) according to the instructions of the supplier. Filters containing various tissue and cell line mRNAs were probed in ExpressHyb hybridization solution (Clontech) and washed at high stringency according to manufacturer's recommendations.

On a human mRNA blot containing mRNA from heart, brain, placenta, lung, liver, skeletal muscle, kidney, and pancreas, Lor-2 transcript (~3.0 kb) was detected in all tissues tested but was most strongly detected in heart and placenta. Moreover, Lor-2 mRNA was strongly expressed in the G361 melanoma cell line and in the SW480 adenocarcinoma colon cell lines (as compared to expression in the HL60, HeLa53, K562, Molty, Raji, and SW480 cell lines (SW480 cell line expressing a 2.4 kb transcript). Transcripts of 5 kb and 2 kb were also detected evidencing possible splice variants of Lor-2.

Testing of a larger panel of human tissues revealed the following expression levels. Expression levels were normalized to beta 2 expression.

TABLE 45 hu Lor-2 Expression in Normal Tissues

| Tissue Source | huLor-2 Expression | Beta 2 Expression | Relative Expression* |
|---|---|---|---|
| Lymph Node (MPI 79) | 30.550 | 18.170 | 10.78 |
| Lymph Node (NDR 173) | 29.930 | 19.190 | 33.59 |
| Heart (PIT 272) | 26.145 | 18.170 | 57.06 |
| Heart (PIT 273) | 29.375 | 19.110 | 46.85 |

TABLE 45-continued hu Lor-2 Expression in Normal Tissues

| Tissue Source | huLor-2 Expression | Beta 2 Expression | Relative Expression* |
|---|---|---|---|
| Lung (MPI 131) | 29.650 | 19.480 | 50.04 |
| Lung (NDR 185) | 27.165 | 17.050 | 51.96 |
| Kidney (MPI 58) | 30.695 | 20.790 | 60.13 |
| Spleen (MPI 360) | 27.005 | 17.150 | 62.25 |
| SK Muscle (MPI 38) | 29.480 | 20.400 | 106.15 |
| Fetal Liver (MPI 425) | 30.065 | 20.520 | 75.85 |
| Fetal Liver (MPI 133) | 31.570 | 23.550 | 221.32 |
| Tonsil (MPI 37) | 29.480 | 17.890 | 18.64 |
| Colon (MPI 383) | 30.045 | 19.830 | 48.50 |
| Brain (MPI 422) | 30.525 | 22.220 | 181.65 |
| Liver (MPI 75) | 32.935 | 20.940 | 14.07 |
| Liver (MPI 365) | 31.060 | 18.770 | 11.35 |
| Liver (MPI 339) | 33.985 | 20.740 | 5.92 |
| Liver (MPI 154) | 32.000 | 19.970 | 13.74 |
| Liver (NDR 206) | 33.750 | 20.370 | 5.41 |
| Liver (PIT 260) | 32.705 | 18.970 | 4.23 |
| CD14 | 26.945 | 17.190 | 66.49 |
| Granulocytes | 30.825 | 19.240 | 18.77 |
| NHLH (resting) | 36.595 | 19.920 | 1.10 |
| NHLH (activated) | 35.570 | 19.760 | 1.00 |
| Liver Fibrosis (MPI 447) | 29.320 | 18.300 | 27.67 |
| Liver Fibrosis (NDR 190) | 36.495 | 24.180 | 22.55 |
| Liver Fibrosis (NDR 191) | 30.105 | 19.770 | 44.63 |
| Liver Fibrosis (NDR 192) | 33.415 | 22.410 | 27.95 |
| Liver Fibrosis (NDR 193) | 30.795 | 19.830 | 28.74 |
| Liver Fibrosis (NDR 204) | 33.360 | 21.580 | 16.34 |
| Liver Fibrosis (NDR 126) | 31.900 | 21.180 | 34.18 |
| Liver Fibrosis (NDR 113) | 29.175 | 18.510 | 36.51 |
| Liver Fibrosis (NDR 79) | 30.870 | 20.390 | 40.22 |
| Liver Fibrosis (NDR 112) | 31.955 | 21.770 | 49.52 |
| Liver Fibrosis (NDR 225) | 30.645 | 20.350 | 45.89 |
| Liver Fibrosis (NDR 141) | 33.045 | 22.250 | 32.45 |

NHLH activated used as reference sample

Next, Lor-2 expression levels were measured in a variety of tissue and cell samples using the TaqMan™ procedure.

TABLE 46 hu Lor-2 3' UTR Expression in Normal Human Tissues

| Tissue Source | Relative Expression* | Tissue Source | Relative Expression* |
|---|---|---|---|
| Prostate | 2.5 | Aorta | 11.8 |
| Prostate | 10.9 | Testis | 16.4 |
| Liver | 2.4 | Testis | 21.7 |
| Liver | 2.5 | Thyroid | 4.4 |
| Breast | 26.7 | Thyroid | 7.2 |
| Breast | 59.3 | Placenta | 73.3 |
| Skeletal Muscle | 13.4 | Placenta | 61.8 |
| Skeletal Muscle | 5.5 | Fetal Kidney | 87.7 |
| | | Fetal Liver | 10.0 |
| | | Fetal Liver | 64.7 |
| Brain | 12.6 | Fetal Heart | 14.4 |
| Brain | 12.7 | Fetal Heart | 70.8 |
| Colon | 7.2 | Osteoblasts (undif.) | 207.9 |
| Colon | 3.4 | | |
| Heart | 1.8 | Osteoblasts (dif.) | 128.0 |
| Heart | 1.8 | | |
| Ovary | 1.8 | Small Intestine | 7.9 |
| Ovary | 1.4 | | |
| Kidney | 1.0 | Cervix | 86.5 |
| Kidney | 2.3 | Spleen | 6.3 |
| Lung | 1.8 | Esophagus | 2.4 |
| Lung | 4.2 | Thymus | 1.4 |
| Vein | 57.5 | Tonsil | 1.7 |
| Vein | 16.1 | Lymphnode | 3.1 |

Kidney used as reference sample

The highest expression was observed in osteoblasts, cervix, kidney and placenta on the normal human tissue panel tested.

Expression of 21967 or Lor-2 mRNA in Clinical Tumor Samples and in Xenograft Cell Lines In this example, RT-PCR was used to detect the presence of Lor-2 mRNA in various tumor and metastatic tissue samples as compared to normal tissue samples. RT-PCR was also used to detect the presence of Lor-2 mRNA in various xenograft cell lines. In breast tissue, Lor-2 mRNA was detected in 0/1 normal tissue samples as compared to 3/4 tumor clinical samples after 30 cycles of PCR. In xenograft cell lines isolated from breast tissue, Lor-2 mRNA was detected in 1/1 normal and 3/3 xenograft cell lines (cell lines MCF7, ZR75 and T47D). In lung tissue, Lor-2 mRNA was detected in 0/2 normal tissue samples as compared to 2/8 tumor tissue samples. In xenograft cell lines isolated from lung tissue, Lor-2 mRNA was detected in 0/5 xenograft cell lines after 30 cycles of PCR. In a second experiment performed with lung tissue, Lor-2 mRNA was detected in 2/2 normal and 8/8 tumor tissue samples, as well as in 5/5 xenograft cell lines (cell lines A549, H69, H125, H322 and H460) after 35 cycles of PCR. In colon tissue, Lor-2 mRNA was detected in 2/2 normal, 5/5 tumor and 5/5 metastatic samples, as well as in 7/7 xenograft cell lines (cell lines HCT116, HCT15, HT29, SW620, SW480, DLD1 and KM12) after 35 cycles of PCR. In liver tissue, LOR-2 mRNA was detected in 2/2 normal samples after 35 cycles of PCR. These data reveal that there exists a correlation between tumors and Lor-2 expression, at least in breast and lung tissues.

To further investigate this finding, Lor-2 mRNA levels were measured by quantitative PCR using the TaqMan™ procedure as described above. The procedure was carried out on cDNA generated from various carcinoma samples and compared to normal counterpart tissue samples. In 5/7 breast carcinomas, a 2-86 fold upregulation of Lor-2 was observed as compared to 2/4 normal breast tissue samples. Likewise, in 4/7 lung carcinomas, a 2-17 fold upregulation was observed as compared to 3/4 normal lung tissue samples. The relative levels of Lor-2 mRNA detected in various normal, tumor and metastases samples are set forth in Table 47.

TABLE 47 hu Lor-2 Expression - TaqMan Analysis of Oncology Panel

| Tissue Source | Relative Expression | Tissue Source | Relative Expression |
|---|---|---|---|
| Breast N | 46.85 | Colon N | 48.50 |
| Breast N | 18.96 | Colon N | 4.94 |

TABLE 47-continued hu Lor-2 Expression - TaqMan Analysis of Oncology Panel

| Tissue Source | Relative Expression | Tissue Source | Relative Expression |
|---|---|---|---|
| Breast N | 1.00 | Colon N | 10.09 |
| Breast N | 11.75 | Colon N | 4.94 |
| Breast T | 86.52 | Colon T | 10.78 |
| Breast T | 37.27 | Colon T | 10.89 |
| Breast T | 25.72 | Colon T | 17.39 |
| Breast T | 60.76 | Colon T | 10.82 |
| Breast T | 19.84 | Colon T | 9.09 |
| Breast T | 22.24 | Colon T | 26.63 |
| Breast T | 16.26 | Liver | 10.93 |
| Lung N | 9.32 | Met | |
| Lung N | 3.34 | Liver | 10.30 |
| Lung N | 1.65 | Met | |
| Lung N | 3.84 | Liver | 12.25 |
| Lung T | 4.26 | Met | |
| Lung T | 7.39 | Liver | 12.91 |
| Lung T | 9.13 | Met | |
| Lung T | 12.08 | Liver N | 4.30 |
| Lung T | 6.48 | Liver N | 3.69 |
| Lung T | 17.27 | Liver N | 3.48 |
| Lung T | 28.15 | Liver N | 5.41 |

These data reveal a significant upregulation of Lor-2 mRNA in at least breast and lung carcinomas. Moreover, there was a significant upregulation of Lor-2 expression in metastatic as compared to normal liver samples. Given that the mRNA for Lor-2 is expressed in a variety of tumors, with significant upregulation in carcinoma samples in comparison to normal samples, it is believed that inhibition of Lor-2 activity may inhibit tumor progression by affecting the adhesive properties of the tumor cells to surrounding tissues.

Human 1983 (SLGP)

The present invention is based, at least in part, on the discovery of novel G-protein coupled receptor (GPCR) family members, referred to herein as SLGP protein and nucleic acid molecules. The human SLGP molecules are also referred to as "1983" molecules and the mouse SLGP molecules are also referred to as "12231 or "m1983" molecules. The present invention also provides methods and compositions for the diagnosis and treatment of cellular proliferation, growth, differentiation, or migration disorders (e.g., cancer, arthritis, retinal and optic disk neovascularization, and tissue ischemia, such as myocardial ischemia).

The present invention is also based, at least in part, on the discovery that the novel SLGP molecules of the present invention are upregulated in in vitro proliferating and tube forming Human Dermal Microvascular Endothelial Cells (HMVEC) (see details below), are expressed in endothelial cells of glioblastomas as compared to normal brains (see details below), and are upregulated in VEGF-induced angiogenic xenograft plugs as compared to parental xenografts (see details below). Therefore, the SLGP molecules of the present invention modulate angiogenesis by endothelial cells (e.g., tumor endothelial cells). Accordingly, the SLGP molecules of the present invention are useful as targets for developing modulating agents to regulate a variety of cellular processes including angiogenesis (e.g., the proliferation, elongation, and migration of endothelial cells, such as endothelial cells in tumors). Angiogenesis is responsible for the formation of new vessels in tumor sites. The new vessels provide the oxygen and nutritional supply to tumors. Therefore, the SLGP modulators of the invention can modulate tumor formation and growth by modulating angiogenesis. For example, inhibition of the activity of an SLGP molecule can cause decreased angiogenesis, i.e., a decrease in cellular proliferation, elongation, and migration of endothelial cells and, thus, a decrease in the formation of new vessels, and a decrease in the supply of oxygen and nutrition to a tumor. Therefore, the SLGP modulators of the invention can be used to treat formation and growth of tumors, e.g., cancer, and other diseases characterized by excessive vessel formation such as arthritis and retinopathy. Additionally, increasing the activity of an SLGP molecule can cause increased angiogenesis and, therefore, increased vessel formation and can, thus, be used in treating diseases characterized by decreased vessel formation, e.g., tissue ischemia. Therefore, the SLGP molecules of the present invention are useful as targets and therapeutic agents for the modulation of diseases characterized by decreased angiogenesis, e.g., tissue ischemia, such as myocardial ischemia.

The SLGP protein is a GPCR that participates in signaling pathways within cells, e.g., signaling pathways involved in proliferation or differentiation. As used herein, a signaling pathway refers to the modulation (e.g., the stimulation or inhibition) of a cellular function/activity upon the binding of a ligand to the GPCR (SLGP protein). Examples of such functions include mobilization of intracellular molecules that participate in a signal transduction pathway, e.g., phosphatidylinositol 4,5-bisphosphate ($PIP_2$), inositol 1,4,5-triphosphate ($IP_3$) or adenylate cyclase; polarization of the plasma membrane; production or secretion of molecules; alteration in the structure of a cellular component; cell proliferation, e.g., synthesis of DNA and angiogenesis, e.g., proliferation, elongation, and migration of endothelial cells (e.g., tumor endothelial cells) to form new vessels (e.g., endothelial tubes); cell differentiation; and cell survival.

Regardless of the cellular activity modulated by SLGP, it is universal that as a GPCR, the SLGP protein interacts with a "G protein" to produce one or more secondary signals in a variety of intracellular signal transduction pathways, e.g., through phosphatidylinositol or cyclic AMP metabolism and turnover, in a cell. G proteins represent a family of heterotrimeric proteins composed of $\alpha$, $\beta$ and $\gamma$ subunits, which bind guanine nucleotides. These proteins are usually linked to cell surface receptors, e.g., receptors containing seven transmembrane domains, such as the ligand receptors. Following ligand binding to the receptor, a conformational change is transmitted to the G protein, which causes the $\alpha$-subunit to exchange a bound GDP molecule for a GTP molecule and to dissociate from the $\beta\gamma$-subunits. The GTP-bound form of the $\alpha$-subunit typically functions as an effector-modulating moiety, leading to the production of second messengers, such as cyclic AMP (e.g., by activation of adenylate cyclase), diacylglycerol or inositol phosphates. Greater than 20 different types of $\alpha$-subunits are known in man, which associate with a smaller pool of $\beta$ and $\gamma$ subunits. Examples of mammalian G proteins include Gi, Go, Gq, Gs and Gt. G proteins are described extensively in Lodish H. et al. Molecular Cell Biology, (Scientific American Books Inc., New York, N.Y., 1995), the contents of which are incorporated herein by reference.

As used herein, the phrase "phosphatidylinositol turnover and metabolism" includes the molecules involved in the turnover and metabolism of phosphatidylinositol 4,5-bisphosphate ($PIP_2$) as well as to the activities of these molecules. $PIP_2$ is a phospholipid found in the cytosolic leaflet of the plasma membrane. Binding of a ligand to the SLGP activates, in some cells, the plasma-membrane enzyme phospholipase C that in turn can hydrolyze $PIP_2$ to produce 1,2-diacylglycerol (DAG) and inositol 1,4,5-triphosphate ($IP_3$). Once formed $IP_3$ can diffuse to the endoplasmic reticulum surface where it can bind an $IP_3$ receptor, e.g., a calcium channel protein containing an IP$_3$ binding site. IP$_3$ binding can induce opening of the channel, allowing calcium ions to be released into the cytoplasm. IP$_3$ can also be phosphorylated by a specific kinase to form inositol 1,3,4,5-tetraphosphate (IP$_4$), a molecule which can cause calcium entry into the cytoplasm from the extracellular medium. IP$_3$ and IP$_4$ can subsequently be hydrolyzed very rapidly to the inactive products inositol 1,4-biphosphate (IP$_2$) and inositol 1,3,4-triphosphate, respectively. These inactive products can be recycled by the cell to synthesize PIP$_2$. The other second messenger produced by the hydrolysis of PIP$_2$, namely 1,2-diacylglycerol (DAG), remains in the cell membrane where it can serve to activate the enzyme protein kinase C. Protein kinase C is usually found soluble in the cytoplasm of the cell, but upon an increase in the intracellular calcium concentration, this enzyme can move to the plasma membrane where it can be activated by DAG. The activation of protein kinase C in different cells results in various cellular responses such as the phosphorylation of glycogen synthase, or the phosphorylation of various transcription factors, e.g., NF-kB. The language "phosphatidylinositol activity", as used herein, includes an activity of PIP$_2$ or one of its metabolites.

Another signaling pathway in which the SLGP protein may participate is the cAMP turnover pathway. As used herein, "cyclic AMP turnover and metabolism" includes molecules involved in the turnover and metabolism of cyclic AMP (cAMP) as well as to the activities of these molecules. Cyclic AMP is a second messenger produced in response to ligand induced stimulation of certain G protein coupled receptors. In the ligand signaling pathway, binding of ligand to a ligand receptor can lead to the activation of the enzyme adenylate cyclase, which catalyzes the synthesis of cAMP. The newly synthesized cAMP can in turn activate a cAMP-dependent protein kinase.

The SLGP molecules of the present invention are involved in modulation of cellular proliferation, growth, differentiation, or migration processes. As used herein, a "cellular proliferation, growth, differentiation, or migration process" includes a process by which a cell e.g., an endothelial cell, increases in number, size, or content; by which a cell develops a specialized set of characteristics which differ from that of other cells; or by which a cell moves closer to or further from a particular location or stimulus (e.g., angiogenesis). As used herein, "cellular proliferation, growth, differentiation, or migration disorders" include cancer, e.g., carcinoma, sarcoma, or leukemia; tumor angiogenesis and metastasis; and other diseases which are characterized by increased or deceased angiogenesis, including, but not limited to arthritis, retinal and optic disk neovascularization, and tissue ischemia, such as myocardial ischemia.

The activity of the SLGP proteins of the invention may also be implicated in cardiovascular disorders, congestive heart failure, or other cardiac cellular processes. As used herein, the term "cardiovascular disorder" includes a disease, disorder, or state involving the cardiovascular system, e.g., the heart, the blood vessels, and/or the blood. A cardiovascular disorder can be caused by an imbalance in arterial pressure, a malfunction of the heart, or an occlusion of a blood vessel, e.g., by a thrombus. Examples of such disorders include hypertension, atherosclerosis, coronary artery spasm, coronary artery disease, valvular disease, arrhythmias, cardiomyopathies (e.g., dilated cardiomyopathy, idiopathic cardiomyopathy), arteriosclerosis, ischemia reperfusion injury, restenosis, arterial inflammation, vascular wall remodeling, ventricular remodeling, rapid ventricular pacing, coronary microembolism, tachycardia, bradycardia, pressure overload, aortic bending, coronary artery ligation, vascular heart disease, atrial fibrillation, long-QT syndrome, congestive heart failure, sinus node disfunction, angina, heart failure, hypertension, atrial fibrillation, atrial flutter, myocardial infarction, cardiac hypertrophy, and coronary artery spasm.

As used herein, the term "congestive heart failure" includes a condition characterized by a diminished capacity of the heart to supply the oxygen demands of the body. Symptoms and signs of congestive heart failure include diminished blood flow to the various tissues of the body, accumulation of excess blood in the various organs, e.g., when the heart is unable to pump out the blood returned to it by the great veins, exertional dyspnea, fatigue, and/or peripheral edema, e.g., peripheral edema resulting from left ventricular dysfunction. Congestive heart failure may be acute or chronic. The manifestation of congestive heart failure usually occurs secondary to a variety of cardiac or systemic disorders that share a temporal or permanent loss of cardiac function. Examples of such disorders include hypertension, coronary artery disease, valvular disease, and cardiomyopathies, e.g., hypertrophic, dilative, or restrictive cardiomyopathies. Congestive heart failure is described in, for example, Cohn J. N. et al. (1998) *American Family Physician* 57:1901-04, the contents of which are incorporated herein by reference.

As used herein, the term "cardiac cellular processes" includes intra-cellular or inter-cellular processes involved in the functioning of the heart. Cellular processes involved in the nutrition and maintenance of the heart, the development of the heart, or the ability of the heart to pump blood to the rest of the body are intended to be covered by this term. Such processes include, for example, cardiac muscle contraction, distribution and transmission of electrical impulses, and cellular processes involved in the opening and closing of the cardiac valves. The term "cardiac cellular processes" further includes processes such as the transcription, translation and post-translational modification of proteins involved in the functioning of the heart, e.g., myofilament specific proteins, such as troponin I, troponin T, myosin light chain 1 (MLC1), and α-actinin.

The novel SLGP molecules of the present invention comprise a family of molecules having certain conserved structural and functional features. The term "family" when referring to the protein and nucleic acid molecules of the invention is intended to mean two or more proteins or nucleic acid molecules having a common structural domain or motif and having sufficient amino acid or nucleotide sequence homology as defined herein. Such family members can be naturally or non-naturally occurring and can be from either the same or different species. For example, a family can contain a first protein of human origin, as well as other, distinct proteins of human origin or alternatively, can contain homologues of non-human origin. Members of a family may also have common functional characteristics.

For example, the family of G protein-coupled receptors (GPCRs), to which the SLGP proteins of the present invention bear significant homology, comprise an N-terminal domain, seven transmembrane domains (also referred to as membrane-spanning domains), six loop domains, and a C-terminal cytoplasmic domain (also referred to as a cytoplasmic tail). Members of the SLGP family also share certain conserved amino acid residues, some of which have been determined to be critical to receptor function and/or G protein signaling. For example, GPCRs usually contain the following features: a conserved asparagine residue in the first transmembrane domain; a cysteine residue in the second loop which is believed to form a disulfide bond with a conserved cysteine residue in the fourth loop; a conserved leucine and aspartate residue in the second transmembrane domain; an aspartate-arginine-tyrosine motif (DRY motif) at the interface of the third transmembrane domain and the third loop of which the arginine residue is almost invariant (members of the rhodopsin subfamily of GPCRs comprise a histidine-arginine-methionine motif (HRM motif) as compared to a DRY motif); a conserved tryptophan and proline residue in the fourth transmembrane domain; and conserved phenylalanine and leucine residues in the seventh transmembrane domain. Table 48 depicts an alignment of the transmembrane domain of 5 GPCRs. The conserved residues described herein are indicated by asterices.

TABLE 48

Alignment of Transmembrane Domains

| | | | |
|---|---|---|---|
| thrombin | (6.) | human | P25116 |
| rhodopsin | (19.) | human | P08100 |
| m1ACh | (21.) | rat | P08482 |
| IL-8A | (30.) | human | P25024 |
| octopamine | (40.) | Drosophila melanogaster | P22270 |

TM1

```
                              *
 6.       102    TLFVPSVYTGVFVVSLPLNIMAIVVFILKMK    132

19.        37    FSMLAAYMFLLIVLGFPINFLTLYVTVQHKK     67

21.        25    VAFIGITTGLLSLATVTGNLLVLISFKVNTE     55

30.        39    KYVVIIAYALVFLLSLLGNSLVMLVILYSRV     69

40.       109    ALLTALVLSVIIVLTIIGNILVTLSVFTYKP    139
                                |

1111111111111111111111111111111
                 3333333344444444445555555555666
                 2345678901234567890123456789012
```

TM2

```
                           *  *
 6.       138    VVYMLHLATADVLFVSVLPFKISYYFSG       165

19.        73    NYILLNLAVADLFMVLGGFTSTLYTSLH       100

21.        61    NYFLLSLACADLIIGTFSMNLYTTYLLM        88

30.        75    DVYLLNLALADLLFALTLPIWAASKVNG       102

40.       145    NFFIVSLAVADLTVALLVLPFNVAYSIL       172
                              |

222222222222222222222222222
                 444444444555555555566666666
                 012345678901234567890123456 7
```

TM3

```
                                           *
 6.       176    RFVTAAFYCNMYASILLMTVISIDR          200

19.       111    NLEGFFATLGGEIALWSLVVLAIER          135

21.        99    DLWLALDYVASNASVMNLLLISFDR          123

30.       111    KVVSLLKEVNFYSGILLLACISVDR          135

40.       183    KLWLTCDVLCCTSSILNLCAIALDR          207
                                        |

333333333333333333333333
                 222233333333344444444445
                 678901234567890123456789 0
```

TABLE 48-continued

Alignment of Transmembrane Domains

TM4

```
                         *         *
6.      215    TLGRASFTCLAIWALAIAGVVPLVLKE      241
19.     149    GENHAIMGVAFTWVMALACAAPPLAGW      175
21.     138    TPRRAALMIGLAWLVSFVLWAPAILFW      164
30.     149    KRHLVKFVCLGCWGLSMNLSLPFFLFR      175
40.     222    TVGRVLLLISGVWLLSLLISSPPLIGW      248
                                 |
               444444444444444444444444444
               334444444444555555555566666
               890123456789012345678901234
```

TM5

```
                      *     *    *
6.      268    AYYFSAFSAVFFFVPLIISTVCYVSIIRC    296
19.     201    ESFVIYMFVVHFTIPMIIIFFCYGQLVFT    229
21.     186    PIITFGTAMAAFYLPVTVMCTLYWRIYRE    214
30.     200    MVLRILPHTFGFIVPLFVMLFCYGFTLRT    228
40.     267    RGYVIYSSLGSFFIPLAIMTIVYIEIFVA    295
                                   |
               5555555555555555555555555555
               3333444444444455555555556666
               6789012345678901234567890134
```

TM6

```
                         *   *  *
6.      313    FLSAAVFCIFIICFGPTNVLLIAHYSFL     340
19.     252    RMVIIMVIAFLICWVPYASVAFYIFTHQ     279
21.     365    RTLSAILLAFILTWTPYNIMVLVSTFCK     397
30.     242    RVIFAVVLIFLLCWLPYNLVLLADTLMR     269
40.     529    RTLGIIMGVFVICWLPFFLMYVILPFCQ     556
                                 |
               6666666666666666666666666666
               3333344444444445555555556666
               5678901234567890123456789012
```

TM7

```
                          **   *
6.      347    EAAYFAYLLCVCVSSISSCIDPLIYYYASSECQ    379
19.     282    NFGPIFMTIPAFFAKSAAIYNPVIYIMMNKQFR    314
21.     394    CVPETLWELGYWLCYVNSTVNPMCYALCNKAFR    426
30.     281    NNIGRALDATEILGFLHSCLNPIIYAFIGQNFR    313
```

TABLE 48-continued

Alignment of Transmembrane Domains

```
40.       559   CPTNKFKNFITWLGYINSGLNPVIYTIFNLDYR    591
                              |
                7777777777777777777777777777777
                2333333333344444444445555555555566
                90123456789012345678901234567890 1
```

The amino acid sequences of thrombin (Accession No. P25116), rhodopsin (Accession No. P08100), m1ACh (Accession No. P08482), IL-8A (Accession No. P25024), octopamine (Accession No. P22270), can be found as SEQ ID NO:91, SEQ ID NO:92, SEQ ID NO:93, SEQ ID NO:94, SEQ ID NO:95, respectively. Accordingly, GPCR-like proteins such as the SLGP proteins of the present invention contain a significant number of structural characteristics of the GPCR family. For instance, the SLGPs of the present invention contain conserved cysteines found in the first two loops (prior to the third and fifth transmembrane domains) of most GPCRs (cys490 and cys562 of SEQ ID NO:89). A highly conserved asparagine residue is present (asn125 in SEQ ID NO:89). SLGP proteins contains a highly conserved leucine (leu154 of SEQ ID NO:89). The two cysteine residues are believed to form a disulfide bond that stabilizes the functional protein structure. A highly conserved asparagine and arginine in the fourth transmembrane domain of the SLGP proteins is present (asp158 and arg218 of SEQ ID NO:89). Moreover, a highly conserved proline is present (pro307 of SEQ ID NO:89). Proline residues in the fourth, fifth, sixth, and seventh transmembrane domains are thought to introduce kinks in the alpha-helices and may be important in the formation of the ligand binding pocket. Moreover, a conserved tyrosine is present in the seventh transmembrane domain of SLGP-2 (tyr647 of SEQ ID NO:89).

In one embodiment, the SLGP proteins of the present invention contain at least one, two, three, four, five, six, or preferably, seven transmembrane domains. As used herein, the term "transmembrane domain" includes an amino acid sequence of about 15-40 amino acid residues in length, more preferably, about 15-30 amino acid residues in length, and most preferably about 18-25 amino acid residues in length, which spans the plasma membrane. Transmembrane domains are rich in hydrophobic residues, and typically have an α-helical structure. In a preferred embodiment, at least 50%, 60%, 70%, 80%, 90%, 95% or more of the amino acids of a transmembrane domain are hydrophobic, e.g., leucines, isoleucines, tyrosines, or tryptophans. Transmembrane domains are described in, for example, Zagotta W. N. et al, (1996) *Annual Rev. Neuronsci.* 19: 235-63, the contents of which are incorporated herein by reference. In a preferred embodiment, an SLGP protein of the present invention has more than one transmembrane domain, preferably 2, 3, 4, 5, 6, or 7 transmembrane domains. For example, transmembrane domains can be found at about amino acids 433-452, 465-481, 500-524, 533-553, 570-594, 619-635, and 642-666 of SEQ ID NO:89. In a particularly preferred embodiment, an SLGP protein of the present invention has 7 transmembrane domains.

In another embodiment, an SLGP is identified based on the presence of at least one Loop domain, also referred to herein as a 'loop'. As defined herein, the term "loop" includes an amino acid sequence having a length of at least about 4, preferably about 5-10, preferably about 10-20, and more preferably about 20-30, 30-40, 40-50, 50-60, 60-70, 70-80, 80-90, 90-100, or 100-150 amino acid residues, and has an amino acid sequence that connects two transmembrane domains within a protein or polypeptide. Such loop regions may be located either extracellularly or in the cytoplasm. Accordingly, the N-terminal amino acid of a loop is adjacent to a C-terminal amino acid of a transmembrane domain in a naturally-occurring SLGP or SLGP-like molecule, and the C-terminal amino acid of a loop is adjacent to an N-terminal amino acid of a transmembrane domain in a naturally-occurring SLGP or SLGP-like molecule.

As used herein, a "cytoplasmic loop" includes an amino acid sequence located within a cell or within the cytoplasm of a cell. Also as used herein, an "extracellular loop" includes an amino acid sequence located outside of a cell, or extracellularly. For example, loop domains can be found at about amino acid residues 453-464, 482-499, 525-532, 554-569, 595-618, and 636-641 of SEQ ID NO:89.

In another embodiment of the invention, an SLGP is identified based on the presence of a "C-terminal domain", also referred to herein as a C-terminal tail, in the sequence of the protein. As used herein, a "C-terminal domain" includes an amino acid sequence having a length of at least about 10, preferably about 10-25, more preferably about 25-50, more preferably about 50-75, even more preferably about 75-100, 100-150, 150-200, 200-250, 250-300, 300-400, 400-500, or 500-600 amino acid residues and is located within a cell or extracellularly. Accordingly, the N-terminal amino acid residue of a "C-terminal domain" is adjacent to a C-terminal amino acid residue of a transmembrane domain in a naturally-occurring SLGP or SLGP-like protein. For example, a C-terminal domain is found at about amino acid residues 667-690 of SEQ ID NO:89.

In another embodiment, an SLGP is identified based on the presence of an "N-terminal domain", also referred to herein as an N-terminal loop in the amino acid sequence of the protein. As used herein, an "N-terminal domain" includes an amino acid sequence having about 1-500, preferably about 1-400, more preferably about 1-300, more preferably about 1-200, even more preferably about 1-100, and even more preferably about 1-50, 1-25, or 1-10 amino acid residues in length and is located outside of a cell orintracellularly. The C-terminal amino acid residue of a "N-terminal domain" is adjacent to an N-terminal amino acid residue of a transmembrane domain in a naturally-occurring SLGP or SLGP-like protein. For example, an N-terminal domain is found at about amino acid residues 1-432 of SEQ ID NO:89.

Accordingly in one embodiment of the invention, an SLGP includes at least one, preferably 6 or 7, transmembrane domains and and/or at least one loop. In another embodiment, the SLGP further includes an N-terminal domain and/or a C-terminal domain. In another embodiment, the SLGP can include six transmembrane domains, three cytoplasmic loops, and two extracellular loops, or can include six transmembrane domains, three extracellular loops, and 2 cytoplasmic loops. The former embodiment can further include an N-terminal domain. The latter embodiment can further include a C-terminal domain. In another embodiment, the SLGP can include seven transmembrane domains, three cytoplasmic loops, and three extracellular loops and can further include an N-terminal domain or a C-terminal domain.

In another embodiment, an SLGP is identified based on the presence of at least one "7 transmembrane receptor profile", also referred to as a "Secretin family sequence profile", in the protein or corresponding nucleic acid molecule. As used herein, the term "7 transmembrane receptor profile" includes an amino acid sequence having at least about 50-350, preferably about 100-300, more preferably about 150-275 amino acid residues, or at least about 200-258 amino acids in length and having a bit score for the alignment of the sequence to the 7tm_1 family Hidden Markov Model (HMM) of at least 20, preferably 20-30, more preferably 30-40, more preferably 40-50, or 50-75 or greater. The 7tm_1 family HMM has been assigned the PFAM Accession PF00001.

To identify the presence of a 7 transmembrane receptor profile in an SLGP, the amino acid sequence of the protein is searched against a database of HMMs (e.g., the Pfam database, release 2.1) using the default parameters. For example, the hmmsf program, which is available as part of the HMMER package of search programs, is a family specific default program for PF00001 and a score of 15 is the default threshold score for determining a hit. For example, a search using the amino acid sequence of SEQ ID NO:89 was performed against the HMM database resulting in the identification of a 7 TM receptor profile in the amino acid sequence of SEQ ID NO:89. The results of the search are set forth below.

```
Score:  56.37   Seq: 421  678  Model:  75  348
*ksYYyvvYiIYTVGYSMSiaaLlvAMfIFcfFRrLHCtRNYIHMNMFms
    +++Y+++   I  +G  +S++ L + +F F FF   +  TR +IH+N+
S
    SLGP     421
IKDYNILTRITQLGIIISLICLAICIFT-
FWFFSEIQSTRTTIHKNLCCS  469

FILRaisWFIkDWvlyWmYsndeltwHCwMsivwCRivMfFMQYMMMtNY
    L A  +F++    +N    +C  I   +Y+ ++
+
    SLGP     470  LFL-AELVFLVGINT---NTNKL----------
FCSIIAGLLHYFFLAAF  505

FWMLvEGvYLHTLIvMtFFsERqYFWWYylIGWGfPlVFitiWvItRcyY
    WM +EG+ L+  +V   +  + +Y++G  +P+V ++  +  +
Y
    SLGP     506
AWMCIEGIHLYLIVVGVIYNKGFLHKN-
FYIFGYLSPAVVVGFSAALGYRY  555

ENt..nCWDmNDnMwyWWIIrgPIMlsIvVNFFFFINIIRILMtKLRepq
    + T   CW++++N ++ W  +GP   L I+ N++ F   II+ + +
    SLGP     556  YGTTKVCWLSTEN-
NFIWSFIGPACLIILGNLLAFGVIIYKVFRHTAGLK  604

MgEndMqqYWRlvKSTLlLIPLFGIHYMVFaWrPdNhwlwqIYMYFElsl
    +     + +  L L+  +  +F   +  +++  y+ +
    SLGP     605  PEVSCF--ENIRSCARGALALLLLGTTWIFGGLHVV-
HASVVTAYLFTVS  651 iSFQGFFVAiIYCFcNhEVQmEIRRrW*
    +  FQG+F    + C + +   Q+E R
    SLGP     652  NAFQGMFIFLFLCVLSRKIQEEYYRLF   678
```

Accordingly, in one embodiment of the invention, an SLGP protein is a human SLGP protein having a 7 transmembrane receptor profile at about amino acids 421-678 of SEQ ID NO:89. Such a 7 transmembrane receptor profile has the amino acid sequence:

```
IKDYNILTRITQLGTIISLICLAICIFTFWFFSEIQ (SEQ ID NO:96)
STRTTIHKNLCCSLFLAELVFLVGINTNTNKLFCSI
IAGLLHYFFLAAFAWMCIEGIHLYLIVVGVIYNKGF
LHKNFYIFGYLSPAVVVGFSAALGYRYYGTTKVCWL
STENNFIWSFIGPACLIILGNLLAFGVIIYKVFRHT
AGLKPEVSCFENIRSCARGALALLLLGTTWIFGGLH
VVHASVVTAYLFTVSNAFQGMFIFLFLCVLSRKIQE
EYYRLF
```

Accordingly, SLGP proteins having at least 20-30%, 30-49%, 40-50%, 50-60% homology, preferably about 60-70%, more preferably about 70-80%, or about 80-90% homology with the 7 transmembrane receptor profile of human SLGP (e.g., SEQ ID NO:89) are within the scope of the invention.

In another embodiment, an SLGP is identified based on the presence of a "EGF-like domain" in the protein or corresponding nucleic acid molecule. As used herein, the term "EGF-like domain" includes a protein domain having an amino acid sequence of about 55-90, preferably about 60-85, more preferably about 65-80 amino acid residues, or about 70-79 amino acids and having a bit score for the alignment of the sequence to the EGF-like domain (HMM) of at least 6, preferably 7-10, more preferably 10-30, more preferably 30-50, even more preferably 50-75, 75-100, 100-200 or greater. The EGF-like domain HMM has been assigned the PFAM Accession PF00008. Preferably, one or more cysteine residues in the EGF-like domain are conserved among SLGP family members or other proteins containing EGF-like domains (i.e., located in the same or similar position as the cysteine residues in other SLGP family members or other proteins containing EGF-like domains). In a preferred embodiment, an "EGF-like domain" has the consensus sequence X(4)-C—X(0,48)-C—X(3,12)-C—X(1,70)-C—X (1,6)-C—X(2)-G-a-X(0,21)-G-X(2)-C—X, (where C=conserved cysteine involved in a disulfide bond, G=often conserved glycine, a=often conserved aromatic acid, X=any residue); corresponding to SEQ ID NO:97. In another preferred embodiment, an "EGF-like domain" has the consensus sequence C—X—C—X(5)-G-X(2)-C, the 3 C's are involved in disulfide bonds; corresponding to SEQ ID NO:98. In another preferred embodiment, an "EGF-like domain" has the consensus sequence C—X—C—X(2)-[GP]-[FYW]-X(4, 8)—C, the three C's are involved in disulfide bonds; corresponding to SEQ ID NO:99.

To identify the presence of an EGF-like domain in an SLGP protein, make the determination that a protein of interest has a particular profile, the amino acid sequence of the protein is searched against a database of HMMs (e.g., the Pfam database, release 2.1) using the default parameters. For example, the hmmsf program, which is available as part of the HMMER package of search programs, is a family specific default program for PF00008 and a score of 15 is the default threshold score for determining a hit. Alternatively, the threshold score for determining a hit can be lowered (e.g., to 8 bits). A description of the Pfam database can be found in Sonhammer et al. (1997) *Proteins* 28(3)405-420 and a detailed description of HMMs can be found, for example, in Gribskov et al. (1990) *Meth. Enzymol.* 183:146-159; Gribskov et al. (1987) *Proc. Natl. Acad. Sci. USA* 84:4355-4358; Krogh et al. (1994) *J. Mol. Biol.* 235:1501-1531; and Stultz et al. (1993) *Protein Sci.* 2:305-314, the contents of which are incorporated herein by reference. A search was performed against the HMM database resulting in the identification of an EGF-like domain in the amino acid sequence of SEQ ID NO:89. The results of the search, indicating that such a domain is found at residues 22 through 100 of SEQ ID NO:89, are set forth below:

```
Score: 6.16    Seq: 22 53    Model: 1 34
         *CnpNPCmNgGtCvNtp.mYtCiCpeGYmyYtGrrC*
         C+ +PC+ +++C+         C C +G    ++G
SLGP   22 CTKTPCLPNAKCEIRNGIEACYCNMG---FSGNGV    53

Score: 18.87   Seq: 62 100   Model: 1 34
         *CnpN..PCmNgGtCvNtp.mYtCiCpeGYm.y.YtGrrC*
         C ++   C +++ C+NT+ +Y+C C +G++ +  + R+
SLGP   62 CGNLTQSCGENANCTNTEGSYYCMCVPGFRSSSNQ    100
          DRFI
```

All amino acids are described using universal single letter abbreviations according to these motifs.

Such an EGF-like domain has the following amino acid sequence:

```
CTKTPCLPNAKCEIRNGIEACYCNMGFSGNGVCG  (SEQ ID NO:100)
NLTQSCGENANCTNTEGSYYCMCVPGFRSSSNQD
RFI
```

Accordingly, SLGP proteins having at least 50-60% homology, preferably about 60-70%, more preferably about 70-80%, or about 80-90% homology with an EGF-like domain of human SLGP (e.g., SEQ ID NO:100) are within the scope of the invention.

In another embodiment, an SLGP is identified based on the presence of a "NADH-ubiquinone/plastoquinone oxidoreductase chain 4L domain" in the protein or corresponding nucleic acid molecule. As used herein, the term "NADH-ubiquinone/plastoquinone oxidoreductase chain 4L domain" includes a protein domain having an amino acid sequence of about 25-55, preferably about 30-50, more preferably about 35-45 amino acid residues, or about 40-43 amino acids and having a bit score for the alignment of the sequence to the NADH-ubiquinone/plastoquinone oxidoreductase chain 4L domain (HMM) of at least 6, preferably 7-10, more preferably 10-30, more preferably 30-50, even more preferably 50-75, 75-100, 100-200 or greater. The NADH-ubiquinone/plastoquinone oxidoreductase chain 4L domain HMM has been assigned the PFAM Accession PF00420.

To identify the presence of a NADH-ubiquinone/plastoquinone oxidoreductase chain 4L domain in an SLGP protein, make the determination that a protein of interest has a particular profile, the amino acid sequence of the protein is searched against a database of HMMs (e.g., the Pfam database, release 2.1) using the default parameters. For example, the hmmsf program, which is available as part of the HMMER package of search programs, is a family specific default program for PF00420 and a score of 15 is the default threshold score for determining a hit. Alternatively, the threshold score for determining a hit can be lowered (e.g., to 8 bits). A description of the Pfam database can be found in Sonhammer et al. (1997) *Proteins* 28(3)405-420 and a detailed description of HMMs can be found, for example, in Gribskov et al. (1990) *Meth. Enzymol.* 183:146-159; Gribskov et al. (1987) *Proc. Natl. Acad. Sci. USA* 84:4355-4358; Krogh et al. (1994) *J. Mol. Biol.* 235:1501-1531; and Stultz et al. (1993) *Protein Sci.* 2:305-314, the contents of which are incorporated herein by reference. A search was performed against the HMM database resulting in the identification of a NADH-ubiquinone/plastoquinone oxidoreductase chain 4L domain in the amino acid sequence of SEQ ID NO:89. The results of the search, indicating that such a domain is found at residues 475 through 517 of SEQ ID NO:89, are set forth below.

```
Score: 6.77    Seq: 475 517   Model: 1 43
    *MMMMthYHPiIMIaFmmGIMGIlMNRsHmMSMLMCLEmMMLS1*
    ++ + ++   +F+  I G+L +    ++ MC+E++ L L
SLGP    475 LVFLVGINTNTNKLFCSIIAGLLHYFFLAAFAWMCIE
GIHLYL  517
```

All amino acids are described using universal single letter abbreviations according to these motifs.

Such a NADH-ubiquinone/plastoquinone oxidoreductase chain 4L domain has the amino acid sequence:

```
LVFLVGINTNTNKLFCSIIAGLLHYFFLAAFAWM  (SEQ ID NO:101)
CIEGIHLYL
```

Accordingly, SLGP proteins having at least 50-60% homology, preferably about 60-70%, more preferably about 70-80%, or about 80-90% homology with a NADH-ubiquinone/plastoquinone oxidoreductase chain 4L domain of human SLGP (e.g., SEQ ID NO:101) are within the scope of the invention.

In another embodiment, an SLGP protein includes at least an EGF-like domain. In another embodiment, an SLGP protein includes at least an NADH-ubiquinone/plastoquinone oxidoreductase chain 4L domain. In another embodiment, an SLGP protein includes at least a 7 transmembrane receptor profile. In another embodiment, an SLGP protein includes an EGF-like domain, and an NADH-ubiquinone/plastoquinone oxidoreductase chain 4L domain. In another embodiment, an SLGP protein includes an EGF-like domain and a 7 transmembrane receptor profile. In another embodiment, an SLGP protein includes an EGF-like domain, and an NADH-ubiquinone/plastoquinone oxidoreductase chain 4L domain, and a 7 transmembrane receptor profile.

In another embodiment, an SLGP protein includes an NADH-ubiquinone/plastoquinone oxidoreductase chain 4L domain and a 7 transmembrane receptor profile. In another embodiment, an SLGP protein is human SLGP which includes an EGF-like domain having about amino acids 22-100 of SEQ ID NO:89. In another embodiment, an SLGP protein is human SLGP which includes an NADH-ubiquinone/plastoquinone oxidoreductase chain 4L domain having about amino acids 475-517 of SEQ ID NO:89. In another embodiment, an SLGP protein is human SLGP which includes a 7 transmembrane receptor profile having about amino acids 421-678 of SEQ ID NO:89.

In yet another embodiment, an SLGP protein is human SLGP which includes a an EGF-like domain having about amino acids 22-100 of SEQ ID NO:89, an NADH-ubiquinone/plastoquinone oxidoreductase chain 4L domain having about amino acids 475-517 of SEQ ID NO:89, and a 7 transmembrane receptor profile having about amino acids 421-678 of SEQ ID NO:89.

Preferred SLGP molecules of the present invention have an amino acid sequence sufficiently homologous to the amino acid sequence of SEQ ID NO:89 or SEQ ID NO:105. As used herein, the term "sufficiently homologous" refers to a first amino acid or nucleotide sequence which contains a sufficient or minimum number of identical or equivalent (e.g., an amino acid residue which has a similar side chain) amino acid residues or nucleotides to a second amino acid or nucleotide sequence such that the first and second amino acid or nucleotide sequences share common structural domains and/or a common functional activity. For example, amino acid or nucleotide sequences which share common structural domains have at least about 50% homology, preferably 60% homology, more preferably 70%-80%, and even more preferably 90-95% homology across the amino acid sequences of the domains and contain at least one and preferably two structural domains, are defined herein as sufficiently homologous. Furthermore, amino acid or nucleotide sequences which share at least 50%, preferably 60%, more preferably 70-80, or 90-95% homology and share a common functional activity are defined herein as sufficiently homologous.

As used interchangeably herein, an "SLGP activity", "biological activity of SLGP" or "functional activity of SLGP", refers to an activity exerted by an SLGP protein, polypeptide or nucleic acid molecule on an SLGP responsive cell as determined in vivo, or in vitro, according to standard techniques. In one embodiment, an SLGP activity is a direct activity, such as an association with a SLGP-target molecule. As used herein, a "target molecule" or "binding partner" is a molecule with which an SLGP protein binds or interacts in nature, such that SLGP-mediated function is achieved. An SLGP target molecule can be a non-SLGP molecule or an SLGP protein or polypeptide of the present invention. In an exemplary embodiment, an SLGP target molecule is an SLGP ligand. Alternatively, an SLGP activity is an indirect activity, such as a cellular signaling activity mediated by interaction of the SLGP protein with an SLGP ligand.

In a preferred embodiment, an SLGP activity is at least one or more of the following activities: (i) interaction of an SLGP protein with soluble SLGP ligand (e.g., CD55); (ii) interaction of an SLGP protein with a membrane-bound non-SLGP protein; (iii) interaction of an SLGP protein with an intracellular protein (e.g., an intracellular enzyme or signal transduction molecule); (iv) indirect interaction of an SLGP protein with an intracellular protein (e.g., a downstream signal transduction molecule); and (v) modulation of cellular proliferation, growth, differentiation, or migration. In yet another preferred embodiment, an SLGP activity is at least one or more of the following activities: (1) modulation of cellular signal transduction, either in vitro or in vivo; (2) regulation of activation in a cell expressing an SLGP protein exposure to alpha-latrotoxin); (3) regulation of inflammation; or (4) modulation of angiogenesis (e.g., proliferation, elongation, and migration of endothelial cells (e.g. tumor endothelial cells), to form new vessels).

Accordingly, another embodiment of the invention features isolated SLGP proteins and polypeptides having an SLGP activity. Preferred SLGP proteins have at least one transmembrane domain and an SLGP activity. In a preferred embodiment, an SLGP protein has a 7 transmembrane receptor profile and an SLGP activity. In another preferred embodiment, an SLGP protein has an EGF-like domain and an SLGP activity. In another preferred embodiment, an SLGP protein has an NADH-ubiquinone/plastoquinone oxidoreductase chain 4L domain and an SLGP activity. In still another preferred embodiment, an SLGP protein has a 7 transmembrane receptor profile, an EGF-like domain, and SLGP activity. In still another preferred embodiment, an SLGP protein has a 7 transmembrane receptor profile, an EGF-like domain, and an NADH-ubiquinone/plastoquinone oxidoreductase chain 4L domain and an SLGP activity. In still another preferred embodiment, an SLGP protein has a 7 transmembrane receptor profile and an NADH-ubiquinone/plastoquinone oxidoreductase chain 4L domain and an SLGP activity. In still another preferred embodiment, an SLGP protein has an EGF-like domain and an NADH-ubiquinone/plastoquinone oxidoreductase chain 4L domain and an SLGP activity. In still another preferred embodiment, an SLGP protein has a 7 transmembrane receptor profile, an EGF-like domain, an SLGP activity, and an amino acid sequence sufficiently homologous to an amino acid sequence of SEQ ID NO:89 or SEQ ID NO:105.

An alignment of the amino acid sequences of human SLGP (SEQ ID NO:89) and human CD 97 (Accession No. U76764, SEQ ID NO:102) generated utilizing the ALIGN program with the following parameter setting: PAM120, gap penalties: −12/−4 (Myers, E. and Miller, W. (1988) "Optimal Alignments in Linear Space" CABIOS 4:11-17) demonstrated a 27.9% identity between the two sequences.

An alignment of the nucleotide sequences of human SLGP (SEQ ID NO:88) and human CD 97 (Accession No. U76764, SEQ ID NO:103) generated utilizing the ALIGN program with the following parameter setting: PAM120, gap penalties: −12/−4 (Myers, E. and Miller, W. (1988) "Optimal Alignments in Linear Space" CABIOS 4:11-17) demonstrated a 41.8% identity between the two sequences.

The nucleotide sequence of the isolated human SLGP cDNA and the predicted amino acid sequence of the human SLGP polypeptide are shown in SEQ ID NOs:88 and 89, respectively.

The human SLGP cDNA, which is approximately 2987 nucleotides in length (SEQ ID NO:88), encodes a protein which is approximately 690 amino acid residues in length (SEQ ID NO:89).

The nucleotide sequence of the isolated mouse SLGP cDNA and the predicted amino acid sequence of the mouse SLGP polypeptide are shown in SEQ ID NOs:104 and 105, respectively.

The mouse SLGP cDNA, which is approximately 3952 nucleotides in length (SEQ ID NO: 104), encodes a protein which is approximately 689 amino acid residues in length (SEQ ID NO: 105).

Isolation of the Human and Mouse SLGP cDNAs

In order to identify novel secreted and/or membrane-bound proteins, a program termed 'signal sequence trapping' was utilized to analyze the sequences of several cDNAs of a cDNA library derived from bronchial epithelial cells which had been stimulated with the cytokine, TNFα. This analysis identified a human clone having an insert of approximately 3 kb containing a protein-encoding sequence of approximately 2987 nucleotides capable of encoding approximately 690 amino acids of SLGP (e.g., the starting methionine through residue 690 of, for example, SEQ ID NO:89).

The nucleotide sequence encoding the human SLGP protein is set forth as SEQ ID NO:88. The full length protein encoded by this nucleic acid is comprised of about 690 amino acids and has the amino acid sequence set forth as SEQ ID NO:89. The coding portion (open reading frame) of SEQ ID NO:88 is set forth as SEQ ID NO:90.

The nucleotide sequence encoding the mouse SLGP protein is set forth as SEQ ID NO:104. The full length protein encoded by this nucleic acid is comprised of about 689 amino acids and has the amino acid sequence set forth as SEQ ID NO:105. The coding portion (open reading frame) of SEQ ID NO:104 is set forth as SEQ ID NO:106.

Analysis of Human SLGP

A BLAST search (Altschul et al. (1990) *J. Mol. Biol.* 215:403) of the nucleotide sequence of human SLGP has revealed that SLGP is significantly similar to a protein identified as human CD 97 (Accession No. U76764; SEQ ID NO:102 and 103) and to a protein identified as rat latrophilin (Accession Nos. U78105, U72487).

The SLGP proteins of the present invention contain a significant number of structural characteristics of the GPCR family. For instance, the SLGPs of the present invention contain conserved cysteines found in the first 2 loops (prior to the third and fifth transmembrane domains) of most GPCRs (cys490 and cys562 of SEQ ID NO:89). A highly conserved asparagine residue is present (asn125 in SEQ ID NO:89). SLGP proteins contains a highly conserved leucine (leu154 of SEQ ID NO:89). The two cysteine residues are believed to form a disulfide bond that stabilizes the functional protein structure. A highly conserved asparagine and arginine in the fourth transmembrane domain of the SLGP proteins is present (asp158 and arg218 of SEQ ID NO:89). Moreover, a highly conserved proline is present (pro307 of SEQ ID NO:89). Proline residues in the fourth, fifth, sixth, and seventh transmembrane domains are thought to introduce kinks in the alpha-helices and may be important in the formation of the ligand binding pocket. Moreover, a conserved tyrosine is present in the seventh transmembrane domain of SLGP-2 (tyr647 of SEQ ID NO:89).

As such, the SLGP family of proteins, like the Secretin family of proteins, are referred to herein as G protein-coupled receptor-like proteins.

SLGP is predicted to contain the following sites: N-glycosylation site at residues 15-18, residues 21-24, residues 64-67, residues 74-77, residues 127-130, residues 177-180, residues 188-191, residues 249-252, residues 381-384, and at residues 395-398 of SEQ ID NO:89; Glycosaminoglycan attachment site at residues 49-52 of SEQ ID NO:89; cAMP- and cGMP-dependent protein kinase phosphorylation sites at residues 360-363 of SEQ ID NO:89; Protein kinase C phosphorylation sites at residues 135-137, residues 181-183, residues 233-235, residues 358-360, residues 363-365, residues 400-402, residues 457-459, residues 485-487, residues 558-560, and residues 667-669 of SEQ ID NO:89; Casein kinase II phosphorylation sites at residues 54-57, residues 68-71, residues 76-79, residues 94-97, residues 135-138, residues 150-153, residues 155-158, residues 161-164, residues 181-184, residues 190-193, residues 244-247, residues 310-313, residues 325-328, residues 346-349, and at residues 608-611 of SEQ ID NO:89; Tyrosine kinase phosphorylation site at residues 36-43, and residues 668-675 of SEQ ID NO:89; N-myristoylation sites at residues 38-43, residues 50-55, residues 80-85, residues 382-387, residues 388-393, residues 434-439, residues 480-485, residues 521-526, residues 584-589, and at residues 619-624 of SEQ ID NO:89; Aspartic acid and asparagine hydroxylation at residues 75-86 of SEQ ID NO:89, EF-hand calcium-binding domain at residues 153-165 of SEQ ID NO:89.

Tissue Distribution of SLGP mRNA by Northern Blot Hybridization

This Example describes the tissue distribution of SLGP mRNA, as determined by Northern blot hybridization.

Northern blot hybridizations with the various RNA samples were performed (Clontech Human Multi-tissue Northern I and a human normal and diseased heart tissue northern) under standard conditions and washed under stringent conditions. A 3.2 Kb and a 4.2 Kb mRNA transcript was detected in all tissues tested (heart, brain, placenta, lung, liver, skeletal muscle, kidney, pancreas), with the highest expression in heart. Specifically, the expression was found to be localized to endothelial cells in the heart. Additionally, these transcripts were found in both normal and diseased hearts.

Tissue Distribution Analysis of Human and Mouse SLGP cDNA

The following describes the tissue distribution of human and mouse SLGP cDNA, as determined using the TaqMan™ procedure.

The results from these analyses showed that Human SLGP is upregulated in tube forming Human Microvascular Endothelial Cells (HMVEC) and in proliferating HMVEC as compared to arresting HMVEC. Human SLGP is also upregulated in glioblastomas as compared to normal brain.

Additionally, mouse SLGP was shown to be upregulated in VEGF-induced angiogenic xenograft plugs as compared to parental plugs.

In Situ Hybridization Analysis of Human SLGP

The following describes the tissue distribution of human SLGP as determined using in situ hybridization analysis. For in situ analysis, tissues, e.g. brain and glioblastoma tissues, were first frozen on dry ice.

In situ hybridization results show that the human SLGP gene is expressed in endothelial cells of glioblastomas but not in endothelial cells of normal brains.

Analysis of Human and Mouse SLGP Expression

The following describes the expression of human and mouse SLGP as determined by transcriptional profiling experiments. Expression of human SLGP in proliferating HMVEC and arresting HMVEC was analyzed by transcriptional profiling. The results from this analysis demonstrate that human SLGP is up-regulated in proliferating HMVEC as compared to arresting HMVEC.

Expression of mouse SLGP in VEGF-induced angiogenic plugs and parental xenografts was also analyzed by transcriptional profiling. These results demonstrated that mouse SLGP expression is up-regulated in VEGF-induced angiogenic xenograft plugs as compared to parental xenografts.

Human 38555 and 593

The present invention is based, at least in part, on the discovery of human cDNA molecules which encode proteins which are herein designated 38555 (or 38555) and 593. The invention is also based on the discovery that the protein encoded by a previously described (but otherwise non-characterized) human brain cDNA clone is, or is functionally analogous to, a prostaglandin and thromboxane transmembrane transport protein. These three proteins are integral membrane proteins that facilitate transmembrane transport of charged organic compounds such as one or more of prostaglandins, thromboxanes, hexoses, disaccharides, hormones (e.g. insulin), peptides, neurotransmitters, cytokines, chemokines, and the like. The characteristics of each of these proteins and the cDNAs encoding them are now described separately.

Protein 38555

A cDNA encoding at least a portion of human 38555 protein was isolated from a library of human cDNA clones on the basis of homology to the amino terminal portion of the protein designated 'human prostaglandin transporter' (HPT) in the literature (U.S. Pat. No. 5,792,851; Lu et al. (1996) *J. Clin. Invest.* 98:1142-1149; Kanai et al. (1995) *Science* 268:866-869). Human protein 38555 is predicted by structural analysis to be a transmembrane transporter protein having twelve transmembrane domains.

The full length of the cDNA encoding human protein 38555 (SEQ ID NO:107) is 2563 nucleotide residues. The ORF of this cDNA, nucleotide residues 42 to 1970 of SEQ ID NO:107 (i.e. SEQ ID NO:109), encodes a 643-amino acid protein (SEQ ID NO:108) which exhibits amino acid sequence homology with HPT protein and other prostaglandin transporters. The human 38555 genomic sequence is shown as nucleotide residues 1-50,000 in SEQ ID NO:110 and nucleotide residues 50,124 in SEQ ID NO:118. The gene encoding human protein 38555 maps to human chromosome 15 at q26.1. A PAC clone including this region has been sequenced, and the sequence of that clone is listed in GenBank Accession number AC005319. It was not previously recognized that any protein, let alone protein 38555 was encoded within the portion of the genome encompassed by the PAC clone. The exon and intron structure of the genomic sequence is described in Tables 49 and 50. Table 49 lists the positions of exons in this sequence, and Table 50 lists intron positions and branch sites (bold residues in Table 50 indicate RNA splicing junctions.

TABLE 49

| Exon Designation | Position within SEQ ID NO: 107 | Position within SEQ ID NO: 110/118 | Corresponding Amino Acid Sequence (Residues of SEQ ID NO: 109) |
| --- | --- | --- | --- |
| a | 541-639 | 3683-3781 | 168-199 |
| b | 640-903 | 13078-13341 | 200-287 |
| c | 904-1068 | 29276-29440 | 288-342 |
| d | 1069-1267 | 34872-35070 | 343-408 |
| e | 1268-1406 | 37163-37301 | 409-455 |
| f | 1407-1582 | 55668-55843 | 456-513 |
| g | 1583-1647 | 59634-59698 | 514-535 |
| h | 1648-1890 | 71440-71682 | 536-616 |
| i | 1891-2546 | 80469-81124 | 617-643 |

TABLE 50

| Intron Designation | Position in SEQ ID NO: 110/118 | Donor Site Sequence | Acceptor Site Sequence | Branch Site(s) (TACTAAC) |
| --- | --- | --- | --- | --- |
| i | 0-3682 | | TCAG | |
| ii | 3782-13077 | GTAA | ACAG | 7141-7147 |
| iii | 13342-29275 | GTAA | GCAG | |
| iv | 29441-34871 | GTGA | CCAG | |
| v | 35071-37162 | GTGA | CCAG | |
| vi | 37302-55667 | GTAA | TCAG | 39794-39800, 52196-52202 |
| vii | 55844-59633 | GTAA | GTAG | |
| viii | 59699-71439 | GTAT | ACAG | |
| ix | 71683-80468 | GTGA | TTAG | |

In addition to full length human protein 38555, the invention includes fragments, derivatives, and variants of protein 38555, as described herein. These proteins, fragments, derivatives, and variants are collectively referred to herein as polypeptides of the invention or proteins of the invention.

The invention also includes nucleic acid molecules which encode a polypeptide of the invention. Such nucleic acids include, for example, a DNA molecule having the nucleotide sequence listed in SEQ ID NO:107 or some portion thereof, such as the portion which encodes human protein 38555, or a domain, fragment, derivative, or variant of protein 38555. These nucleic acids are collectively referred to as nucleic acids of the invention.

38555 proteins of the invention and nucleic acid molecules encoding them comprise a family of molecules having certain conserved structural and functional features, as indicated by the conservation of amino acid sequence between protein 38555 and HPT (SEQ ID NO:116), the human OatP sodium-independent organic anion transporter protein (GenBank Accession no. P46721; SEQ ID NO:117), human KIAA0880 protein (GenBank Accession no. 4240248; SEQ ID NO:115), and human protein 593 (as described herein, SEQ ID NO:113).

38555 proteins typically comprise a variety of potential post-translational modification sites (often within an extracellular domain), such as those described herein in Table 51, as predicted by computerized sequence analysis of human 38555 protein using amino acid sequence comparison software (comparing the amino acid sequence of protein 38555 with the information in the PROSITE database {rel. 12.2; February, 1995} and the Hidden Markov Models database {Rel. PFAM 3.3}). In certain embodiments, a protein of the invention has at least 1, 2, 4, 6, 8, 10, 15, or 20 or more of the post-translational modification sites listed in Table 51.

TABLE 51

| Type of Potential Modification Site or Domain | Amino Acid Residues of SEQ ID NO:108 | Amino Acid Sequence |
| --- | --- | --- |
| N-glycosylation site | 104 to 107 | NGSG |
| | 120 to 123 | NRTA |
| | 332 to 335 | NLTT |
| | 408 to 41 | NSTA |
| | 453 to 456 | NSTN |
| | 470 to 473 | NATV |
| cAMP- or cGMP-dependent protein kinase phosphorylation site | 159 to 162 | RKDS |
| | 362 to 365 | KKLS |
| Protein kinase C phosphorylation site | 256 to 258 | SER |
| | 625 to 627 | TEK |
| Casein kinase II phosphorylation site | 16 to 19 | TTLE |
| | 34 to 37 | SSFE |
| | 106 to 109 | SGGD |
| | 151 to 154 | SYID |
| | 200 to 203 | SNLD |
| | 205 to 208 | TPDD |
| | 256 to 259 | SERE |
| | 414 to 417 | SALD |
| | 616 to 619 | TSTE |
| | 628 to 631 | TCPE |
| | 634 to 637 | SPSE |
| Tyrosine kinase phosphorylation site | 158 to 165 | RRKDSSLY |
| N-myristoylation site | 30 to 35 | GVIASS |
| | 64 to 69 | GIVMAL |
| | 70 to 75 | GALLSA |
| | 167 to 172 | GILFTM |
| | 184 to 189 | GSFCTK |
| | 213 to 218 | GAWWGG |
| | 353 to 358 | GIFLGG |
| | 451 to 456 | GCNSTN |
| | 482 to 487 | GCQEAF |
| | 547 to 552 | GIDSTC |
| | 612 to 617 | GGLSTS |
| Sugar (or other) transport domain | 2 to 446 | |
| Kazal domain | 426 to 460 | |

Protein 38555 comprises domains which exhibit homology with known sugar (or other) transport domains and with Kazal domains. In one embodiment, the protein of the invention has at least one domain that is at least 55%, preferably at least about 65%, more preferably at least about 75%, yet more preferably at least about 85%, and most preferably at least about 95% identical to one of these domains. Preferably, the protein of the invention has at least two domains, each of which is at least 55%, preferably at least about 65%, more preferably at least about 75%, yet more preferably at least about 85%, and most preferably at least about 95% identical to either the sugar (or other) transport domain or the Kazal domain of protein 38555.

Sugar (or other) transport domains occur in a variety of proteins involved in transmembrane transport of sugars and other metabolites. Other proteins which comprise such a domain include human glucose transporters GLUT1, GLUT2, GLUT3, GLUT4, GLUT5, GLUT6, and GLUT7, *Escherichia coli* proteins AraE (arabinose-proton symporter), GalP (galactose-proton symporter), citrate-proton symport protein, KgtP (α-ketoglutarate permease), ProP (proline/betaine transporter), and XylE (xylose-proton symporter), *Escherichia coli* hypothetical proteins YabE, YdjE, and YhjE, *Klebsiella pneumoniae* citrate-proton symport protein, *Zymomonas mobilis* glucose facilitated diffusion protein, yeast high and low affinity glucose transport proteins (SNF3 and HXT1 through HXT14), yeast galactose transporter, yeast maltose permease, yeast myo-inositol transporter, yeast carboxylic acid transporter homolog JEN1, yeast hypothetical proteins YBR241c, YCR98c, and YFL040w, *Klyveromyces lactis* lactose permease, *Neurospora crassa* quinate transporter, *Emericella nidulans* quinate permease, *Chlorella* hexose carrier, *Arabidopsis thaliana* glucose transporter, spinach sucrose transporter, *Leishmania donovani* transporters D1 and D2, *Leishmania enriettii* probable transport protein LTP, *Caenorhabditis elegans* hypothetical protein ZK637.1, *Haemophilus influenzae* hypothetical proteins HI0281 and HI0418, and *Bacillus subtilis* hypothetical proteins YxbC and YxdF. Occurrence of a sugar (or other) transport domain in protein 38555 indicates that protein 38555 is involved in transmembrane transport of one or more compounds, most likely a compound having a molecular weight on the order of a hexose or greater (i.e. having a molecular weight greater than about 180). Examples of such compounds include prostaglandins, thromboxanes, hexoses, disaccharides, hormones (e.g. insulin), peptides, neurotransmitters, cytokines, chemokines, and the like. Protein 38555 thus mediates one or more of facilitated diffusion and symport or antiport (e.g. involving co-transport of a proton, a sodium ion, a potassium ion, or another physiological ion).

Kazal domains occur frequently in serine protease inhibitors. However, these domains also occur as extracellular domains in agrins, which are not thought to have roles as protease inhibitors. These domains are characterized by occurrence, preferably within an extracellular domain, of the consensus pattern (SEQ ID NO:119)
C-X$_{(7\ or\ 8)}$-C-X$_6$-Y-X$_3$-C-X$_{(2\ or\ 3)}$-C- wherein standard single-letter amino acid residue codes are used, X being any amino acid residue, and subscripts referring to the number of residues. Agrins are involved in organization of neural synapses, including, for example, interneuronal synapses within the central nervous system (e.g. glutamatergic synapses) and neuromuscular junctions (Martin and Sanes (1997) *Development* 124:3909-3917; Lieth and Fallon (1993) *J. Neurosci.* 13:2509-2514). Agrins are also involved in organization of endothelial cells and astrocytes during formation and maintenance of the blood brain barrier. Thus, occurrence of a Kazal domain in protein 38555 indicates that this protein is involved in formation and maintenance of cell-to-cell interactions, and more particularly that the protein is involved in forming and maintaining neural synapses, including both neuron-to-neuron synapses and neuron-to-non-neural cell synapses (e.g. neuromotor and neuroendocrine synapses).

Human protein 38555 exhibits sequence similarity to HPT (GenBank Accession no. Q92959). An alignment of the amino acid sequences of human protein 38555 (SEQ ID NO:108) and HPT (SEQ ID NO:116) made using the ALIGN program of the GCG software package, pam120.mat scoring matrix, gap penalties −12/−4, demonstrates that the amino acid sequences of the proteins are 32.4% identical.

Protein 38555 is predicted by computerized amino acid sequence analysis (using the MEMSAT computer program) to be a twelve-transmembrane region integral membrane protein having transmembrane regions at approximately the following positions within SEQ ID NO:108: from about amino acid residue 8 to about residue 17; from about amino acid residue 29 to about residue 52; from about amino acid residue 59 to about residue 76; from about amino acid residue 129 to about residue 153; from about amino acid residue 164 to about residue 186; from about amino acid residue 215 to about residue 236;

from about amino acid residue 301 to about residue 324; from about amino acid residue 341 to about residue 361; from about amino acid residue 374 to about residue 392; from about amino acid residue 490 to about residue 513; from about amino acid residue 524 to about residue 548; and from about amino acid residue 575 to about residue 592.

Extracellular domains are predicted to include approximately amino acid residues 18 to 28, 77 to 128, 187 to 214, 325 to 340, 393 to 489, and 549 to 574 of SEQ ID NO:108. Intracellular domains are predicted to include approximately amino acid residues 1 to 7, 53 to 58, 154 to 163, 237 to 300, 362 to 373, 514 to 523, and 593 to 643 of SEQ ID NO:108.

Human protein 38555 can have additional amino acid residues at the amino terminal end of the sequence listed in SEQ ID NO:108 (i.e. the protein can have an additional portion at its amino terminus). For example, protein 38555 can have 1, 2, 4, 6, 10, 15, 20, 25, or 30 or more additional amino acid residues at the amino terminus indicated in SEQ ID NO:108.

As described elsewhere herein, relatively hydrophilic regions are generally located at or near the surface of a protein, and are more frequently effective immunogenic epitopes than are relatively hydrophobic regions. For example, the region of human protein 38555 from about amino acid residue 415 to about amino acid residue 430 appears to be located at or near the surface of the protein, while the region from about amino acid residue 440 to about amino acid residue 450 appears not to be located at or near the surface.

The predicted molecular weight of human protein 38555 is about 69.2 kilodaltons.

A monkey cDNA clone having significant homology with the human cDNA clone encoding protein 38555 was isolated from a monkey brain cDNA library, indicating that human protein 38555 is expressed in brain tissue, although it can, of course, be expressed in other tissues as well.

Biological Function of Human 38555 Proteins, Nucleic Acids Encoding them, and Modulators of These Molecules Human 38555 proteins are involved in disorders which affect both tissues in which they are normally expressed and tissues in which they are normally not expressed. Based on the observation that 38555 protein is expressed in monkey brain and is therefore likely expressed in human brain tissue, human 38555 protein is involved in one or more biological processes which occur in brain and other neurological tissues. In particular, 38555 is involved in modulating growth, proliferation, survival, differentiation, and activity of cells including, but not limited to, central nervous system neurons, peripheral nervous system neurons, motor neurons, sensory neurons, and sympathetic and parasympathetic neural cells of the animal in which it is normally expressed. Protein 38555 is also involved in mediating interactions between cells, particularly between two neurons or between a neuron and a non-neuronal cell such as a muscle or endocrine cell. Thus, 38555 protein has a role in disorders which affect neuronal cells and cells which interact with neurons and their growth, proliferation, survival, differentiation, and activity.

Widespread expression of 38555 has been detected among human tissue types. Thus, the growth-, proliferation-, survival-, differentiation-, and activity-modulating activities of 38555 protein affect cells of many types. Thus, protein 38555 can affect cell-to-cell interactions in a wide variety of cell types.

The presence of the sugar (or other) transport domain in protein 38555 indicates that this protein is involved in transmembrane transport of one or more charged organic compounds such as prostaglandins, thromboxanes, neurotransmitters, hormones, small peptides, short polysaccharides (e.g. disaccharides), and the like. The proteins of the invention are therefore involved in one or more disorders relating to inappropriate uptake or release of such molecules (i.e. including inappropriate failure to take up or release such molecules). Protein 38555 is thus involved in one or more of a variety of cellular uptake and release disorders such as diabetes, nutritional disorders (e.g. vitamin deficiencies, and malnutrition), metabolic disorders (e.g. obesity, porphyrias, hyper- and hypolipoproteinemia, lipidoses, and water, electrolyte, mineral, and acid/base imbalances), and neural transmission disorders (e.g. inappropriate pain, dementia, multiple sclerosis, nerve root disorders, Alzheimer's disease, Parkinson's disease, depression, physical and psychological substance addiction, sexual dysfunction, schizophrenic disorders, delusional disorders, mood disorders, sleep disorders, and the like).

Occurrence of a Kazal domain in human protein 38555 further implicates this protein in neuronal development and transmission. The presence of this domain therefore indicates that 38555 protein is involved in disorders relating to inappropriate formation (i.e. including failure to form) and maintenance (i.e. including deterioration) of neuronal synapses, including both neuron-to-neuron synapses and neuron-to-non-neuronal cell synapses. Thus, in addition to the neural transmission disorders described above, protein 38555 is also implicated in disorders such as stroke, regeneration of chronically or traumatically damaged neuronal structures (including nerve, brain, and spinal cord), developmental neuronal disorders (e.g. spina bifida), neuronal cancers (e.g. gliomas, astrocytomas, ependymomas, pituitary adenomas, and the like), peripheral nerve deficit, cardiac insufficiency, and the like.

The observation that human protein 38555 shares sequence homology with proteins involved in transmembrane prostaglandin transport indicates that 38555 protein has activity identical or analogous to the activity of those proteins, i.e. that 38555 catalyzes or facilitates transmembrane transport of one or more prostaglandins, thromboxanes, other hormones or hormone-like molecules, or other charged organic compounds. Exemplary molecules which can be transported across cell membranes via protein 38555 include one or more charged organic compounds such as prostaglandins $A_1$, $A_2$, $B_1$, $B_2$, $D_2$, $E_1$, $E_2$, $F_{1\alpha}$, $F_{2\alpha}$, $G_2$, $H_2$, $I_2$, and $J_2$ and thromboxanes $A_2$ and $B_2$. Uptake and release of prostaglandins and thromboxanes, for example, are known to be involved in a variety of physiological processes and disorders including glaucoma, ovum fertilization, sperm motility, pregnancy, labor, delivery, abortion, gastric protection, peptic ulcer formation, intestinal fluid secretion, liver protection, liver damage, liver fibrosis, pain stimulation, glomerular filtration, maintenance of body temperature, fever, airway resistance, asthma, chronic obstructive pulmonary disorder, modulation of blood pressure, hypertension, shock, modulation of inflammation, platelet aggregation, abnormal blood coagulation, atherosclerosis, arteriosclerosis, and coronary artery disease. Thus, polypeptides and nucleic acid molecules of the invention, and compounds which bind with or modulate one or more polypeptides and nucleic acid molecules of the invention can be used to prognosticate, diagnose, inhibit, or treat one or more of the disorders listed above or one or more disorders associated with the physiological processes listed above.

Protein 593

A cDNA encoding at least a portion of human 593 protein was identified by assembling isolated sequences derived from a library of human cDNA clones on the basis of homology with the nucleic acid sequence encoding human protein 38555. Human protein 593 is predicted by structural analysis to be a transmembrane transporter protein having twelve transmembrane domains.

The full length of the cDNA encoding human protein 593 (SEQ ID NO:111) is 2276 nucleotide residues. The ORF of this cDNA, nucleotide residues 1 to 1836 of SEQ ID NO:111 (SEQ ID NO:113), encodes a 612-amino acid protein (SEQ ID NO:112) which exhibits amino acid sequence homology with human protein 38555 and other prostaglandin transporters.

In addition to full length human protein 593, the invention includes fragments, derivatives, and variants of protein 593, as described herein. These proteins, fragments, derivatives, and variants are collectively referred to herein as polypeptides of the invention or proteins of the invention.

The invention also includes nucleic acid molecules which encode a polypeptide of the invention. Such nucleic acids include, for example, a DNA molecule having the nucleotide sequence listed in SEQ ID NO:111 or some portion thereof, such as the portion which encodes human protein 593, or a domain, fragment, derivative, or variant of protein 593. These nucleic acids are collectively referred to as nucleic acids of the invention.

Human 593 proteins of the invention and nucleic acid molecules encoding them comprise a family of molecules having certain conserved structural and functional features, as indicated by the close homology of human protein 593 (SEQ ID NO:112) to HPT (SEQ ID NO:117), the human OatP sodium-independent organic anion transporter protein (GenBank Accession no. P46721; SEQ ID NO:116), human KIAA0880 protein (GenBank Accession no. 4240248; SEQ ID NO:115), and human protein 38555 (as described herein, SEQ ID NO:108).

Human 593 proteins typically comprise a variety of potential post-translational modification sites (often within an extracellular domain), such as those described herein in Table 52, as predicted by computerized sequence analysis of human 593 protein using amino acid sequence comparison software (comparing the amino acid sequence of protein 593 with the information in the PROSITE database {rel. 12.2; February, 1995} and the Hidden Markov Models database {Rel. PFAM 3.3}). In certain embodiments, a protein of the invention has at least 1, 2, 4, 6, 8, 10, 15, or 20 or more of the post-translational modification sites listed in Table 52.

TABLE 52

| Type of Potential Modification Site or Domain | Amino Acid Residues of SEQ ID NO:112 | Amino Acid Sequence |
|---|---|---|
| N-glycosylation site | 389 to 392 | NLTA |
|  | 447 to 450 | NLSS |
| Protein kinase C phosphorylation site | 228 to 230 | SQR |
|  | 245 to 247 | SSR |
|  | 258 to 260 | TIR |
|  | 296 to 298 | SPK |
|  | 492 to 494 | TLR |
| Casein kinase II phosphorylation site | 19 to 22 | TSLE |
|  | 37 to 40 | SSYD |
|  | 140 to 143 | TYLD |
|  | 246 to 249 | SRGE |
|  | 251 to 254 | SNPD |
|  | 258 to 261 | TIRD |
|  | 307 to 310 | SASE |
|  | 430 to 433 | TNVD |
|  | 598 to 601 | SAPD |
|  | 602 to 605 | SATD |
| Tyrosine kinase phosphorylation site | 23 to 30 | RRYDLHSY |
| N-myristoylation site | 7 to 12 | GMTVNG |
|  | 33 to 38 | GLIASS |
|  | 103 to 108 | GAVCAD |
|  | 174 to 179 | GALLNI |
|  | 206 to 211 | GSGAAA |
|  | 282 to 287 | GATEAT |
|  | 323 to 328 | GGGGTF |
|  | 373 to 378 | GVTASY |
|  | 423 to 428 | GCPAAT |
|  | 540 to 545 | GQQGSC |
|  | 588 to 593 | GLETCL |
| Amidation site | 183 to 186 | MGRR |
| Aminotransferase class-V pyridoxal phosphate attachment site | 52 to 68 | YFGGSGHKP-RWLGWGVL |
| Sugar (or other) transport domain | 2 to 490 |  |
| Kazal domain | 398 to 4441 |  |

Protein 593 comprises domains which exhibit homology with known sugar (or other) transport domains and with Kazal domains. In one embodiment, the protein of the invention has at least one domain that is at least 55%, preferably at least about 65%, more preferably at least about 75%, yet more preferably at least about 85%, and most preferably at least about 95% identical to one of these domains. Preferably, the protein of the invention has at least two domains, each of which is at least 55%, preferably at least about 65%, more preferably at least about 75%, yet more preferably at least about 85%, and most preferably at least about 95% identical to either the sugar (or other) transport domain or the Kazal domain of protein 593.

Sugar (or other) transport domains occur in a variety of proteins involved in transmembrane transport of sugars and other metabolites. Other proteins which comprise such a domain include human glucose transporters GLUT1, GLUT2, GLUT3, GLUT4, GLUT5, GLUT6, and GLUT7, *Escherichia coli* proteins AraE (arabinose-proton symporter), GalP (galactose-proton symporter), citrate-proton symport protein, KgtP (α-ketoglutarate permease), ProP (proline/betaine transporter), and XylE (xylose-proton symporter), *Escherichia coli* hypothetical proteins YabE, YdjE, and YhjE, *Klebsiella pneumoniae* citrate-proton symport protein, *Zymomonas mobilis* glucose facilitated diffusion protein, yeast high and low affinity glucose transport proteins (SNF3 and HXT1 through HXT14), yeast galactose transporter, yeast maltose permease, yeast myo-inositol transporter, yeast carboxylic acid transporter homolog JEN1, yeast hypothetical proteins YBR241c, YCR98c, and YFL040w, *Klyveromyces lactis* lactose permease, *Neurospora crassa* quinate transporter, *Emericella nidulans* quinate permease, *Chlorella* hexose carrier, *Arabidopsis thaliana* glucose transporter, spinach sucrose transporter, *Leishmania donovani* transporters D1 and D2, *Leishmania enriettii* probable transport protein LTP, *Caenorhabditis elegans* hypothetical protein ZK637.1, *Haemophilus influenzae* hypothetical proteins HI0281 and HI0418, and *Bacillus subtilis* hypothetical proteins YxbC and YxdF. Occurrence of a sugar (or other) transport domain in protein 593 indicates that protein 593 is involved in transmembrane transport of one or more compounds, most likely a compound having a molecular weight on the order of a hexose or greater (i.e. having a molecular weight greater than about 180). Examples of such compounds include prostaglandins, thromboxanes, hexoses, disaccharides, hormones (e.g. insulin), peptides, neurotransmitters, cytokines, chemokines, and the like. Protein 593 thus mediates one or more of facilitated diffusion and symport or antiport (e.g. involving co-transport of a proton, a sodium ion, a potassium ion, or another physiological ion). One, both, or neither of a glycosaminoglycan attached at the predicted glycosaminoglycan attachment site and a pyridoxal phosphate moiety attached at the predicted pyridoxal phosphate attachment site can, in conjunction with the amino acid sequence of protein 593, determine the specificity of the protein for transporting molecules across the membrane of a cell in which it is expressed.

Like human protein 38555, as described above, human protein 593 comprises a Kazal domain. Occurrence of a Kazal domain in protein 593 indicates that this protein is involved in formation and maintenance of cell-to-cell interactions, and more particularly that the protein is involved in forming and maintaining neural synapses, including both neuron-to-neuron synapses and neuron-to-non-neural cell synapses (e.g. neuromotor and neuroendocrine synapses).

Human protein 593 exhibits sequence similarity to HPT (GenBank Accession no. Q92959). Protein 593 is a twelve-transmembrane region integral membrane protein having transmembrane regions at approximately the following positions within SEQ ID NO:112: from about amino acid residue 1 to about residue 10; from about amino acid residue 33 to about residue 53; from about amino acid residue 62 to about residue 79; from about amino acid residue 118 to about residue 142; from about amino acid residue 153 to about residue 177; from about amino acid residue 200 to about residue 221; from about amino acid residue 262 to about residue 283; from about amino acid residue 314 to about residue 334; from about amino acid residue 347 to about residue 364; from about amino acid residue 469 to about residue 493; from about amino acid residue 509 to about residue 528; and from about amino acid residue 556 to about residue 579.

Extracellular domains are predicted to include approximately amino acid residues 11 to 32, 80 to 117, 178 to 199, 284 to 313, 365 to 468, and 529 to 555 of SEQ ID NO:112. Intracellular domains are predicted to include approximately amino acid residues 54 to 61, 143 to 152, 222 to 261, 335 to 346, 494 to 508, and 580 to 612 of SEQ ID NO:112.

Human protein 593 can have additional amino acid residues at the amino terminal end of the sequence listed in SEQ ID NO:112 (i.e. the protein can have an additional portion at its amino terminus). For example, protein 593 can have 1, 2, 4, 6, 10, 15, 20, 25, or 30 or more additional amino acid residues at the amino terminus indicated in SEQ ID NO:12.

As described elsewhere herein, relatively hydrophilic regions are generally located at or near the surface of a protein, and are more frequently effective immunogenic epitopes than are relatively hydrophobic regions. For example, the region of human protein 593 from about amino acid residue 240 to about amino acid residue 260 appears to be located at or near the surface of the protein, while the region from about amino acid residue 415 to about amino acid residue 430 appears not to be located at or near the surface.

The predicted molecular weight of human protein 593 is about 65.4 kilodaltons.

Biological Function of Human 593 Proteins, Nucleic Acids Encoding Them, and Modulators of These Molecules Human 593 proteins are involved in disorders which affect both tissues in which they are normally expressed and tissues in which they are normally not expressed. Based on the observation that 593 protein exhibits amino acid sequence homology to human protein 38555, which is expressed in monkey brain and is therefore likely expressed in human brain tissue, human 593 protein is involved in one or more biological processes which occur in brain and other neurological tissues, although it can also be expressed in other tissues, and involved in disorders in those tissues as well. In particular, 593 is involved in modulating growth, proliferation, survival, differentiation, and activity of cells including, but not limited to, central nervous system neurons, peripheral nervous system neurons, motor neurons, sensory neurons, and sympathetic and parasympathetic neural cells of the animal in which it is normally expressed. Protein 593 is also involved in mediating interactions between cells, particularly between two neurons, or between a neuron and a non-neuronal cell such as a muscle or endocrine cell. Thus, 593 protein has a role in disorders which affect neuronal cells and cells which interact with neurons and their growth, proliferation, survival, differentiation, and activity.

Widespread expression of 593 has been detected among human tissue types. Thus, the growth-, proliferation-, survival-, differentiation-, and activity-modulating activities of 593 protein affect cells of many types. Thus, protein 593 can affect cell-to-cell interactions in a wide variety of cell types.

Protein 593 can also be expressed in other tissues which normally produce or are acted upon by prostaglandins and thromboxanes. Such tissues include, by way of example, blood tissues (e.g. blood platelets), epithelial tissues such as stomach, kidney, lung, uterus, vascular, and other epithelia, liver, ova, and spermatozoa. Protein 593 is thus involved in one or more disorders which affect these tissues, such as one or more of the tissues listed above in the discussion regarding protein 38555.

The presence of the sugar (or other) transport domain in protein 593 indicates that this protein is involved in transmembrane transport of one or more molecules such as neurotransmitters, prostaglandins, thromboxanes, hormones, small peptides, short polysaccharides (e.g. disaccharides), other charged organic compounds, and the like. The proteins of the invention are therefore involved in one or more disorders relating to inappropriate uptake or release of such molecules (i.e. including inappropriate failure to take up or release such molecules). Protein 593 is thus involved in one or more of a variety of cellular uptake and release disorders such as diabetes, nutritional disorders (e.g. vitamin deficiencies, and malnutrition), metabolic disorders (e.g. obesity, porphyrias, hyper- and hypolipoproteinemia, lipidoses, and water, electrolyte, mineral, and acid/base imbalances), and neural transmission disorders (e.g. inappropriate pain, dementia, multiple sclerosis, nerve root disorders, Alzheimer's disease, Parkinson's disease, depression, physical and psychological substance addiction, sexual dysfunction, schizophrenic disorders, delusional disorders, mood disorders, sleep disorders, and the like).

Occurrence of a Kazal domain in human protein 593 further implicates this protein in neuronal development and neuronal transmission processes. The presence of this domain therefore indicates that 593 protein is involved in disorders relating to inappropriate formation (i.e. including failure to form) and maintenance (i.e. including deterioration) of neuronal synapses, including both neuron-to-neuron synapses and neuron-to-non-neuronal cell synapses. Thus, in addition to the neural transmission disorders described above, protein 593 is also implicated in disorders such as stroke, regeneration of chronically or traumatically damaged neuronal structures (including nerve, brain, and spinal cord), developmental neuronal disorders (e.g. spina bifida), neuronal cancers (e.g. gliomas, astrocytomas, ependymomas, pituitary adenomas, and the like), peripheral nerve deficit, coronary insufficiency, angina, and the like.

The observation that human protein 593 shares sequence homology with proteins involved in transmembrane prostaglandin transport indicates that 593 protein has activity identical or analogous to the activity of those proteins, i.e. that 593 catalyzes or facilitates transmembrane transport of one or more prostaglandins, thromboxanes, other hormones or hormone-like molecules, or other charged organic compounds. Exemplary molecules which can be transported across cell membranes via protein 593 include charged organic compounds, such as one or more of prostaglandins $A_1$, $A_2$, $B_1$, $B_2$, $D_2$, $E_1$, $E_2$, $F_{1\alpha}$, $F_{2\alpha}$, $G_2$, $H_2$, $I_2$, and $J_2$ and thromboxanes $A_2$ and $B_2$. Uptake and release of prostaglandins and thromboxanes, for example, are known to be involved in a variety of physiological processes and disorders including glaucoma, ovum fertilization, sperm motility, pregnancy, labor, delivery, abortion, gastric protection, peptic ulcer formation, intestinal fluid secretion, liver protection, liver damage, liver fibrosis, pain stimulation, glomerular filtration, maintenance of body temperature, fever, airway resistance, asthma, chronic obstructive pulmonary disorder, modulation of blood pressure, hypertension, shock, modulation of inflammation, platelet aggregation, abnormal blood coagulation, atherosclerosis, arteriosclerosis, and coronary artery disease. Thus, polypeptides and nucleic acid molecules of the invention, and compounds which bind with or modulate one or more polypeptides and nucleic acid molecules of the invention can be used to prognosticate, diagnose, inhibit, or treat one or more of the disorders listed above or one or more disorders associated with the physiological processes listed above.

Protein KIAA0880

A cDNA encoding at least a portion of human KIAA0880 protein was isolated by others from a human brain library of cDNA clones on the basis of the encoded protein being 'large' (Nagase et al. (1998) *DNA Res.* 5:355-364; GenBank submission assigned Accession no. AB020687, submitted Dec. 2, 1998). At the time this cDNA was isolated and submitted to GenBank, it was unknown by the isolators whether the encoded protein had any physiological relevance and, if it did, what that relevance might be. The present inventor has discovered that the protein encoded by the cDNA clone identified by Nagase et al. encodes a transmembrane transport protein that catalyzes transmembrane transport of charged organic compounds such as one or more prostaglandins. In view of this discovery, it is now possible to make use of protein KIAA0880 for the treatment of numerous disorders relating to aberrant transmembrane transport of prostaglandins and/or thromboxanes, and for other purposes.

The full length of the cDNA encoding human protein KIAA0880 (SEQ ID NO:114) is 4068 nucleotide residues and encodes a 709-amino acid protein (SEQ ID NO:115) which exhibits amino acid sequence homology with HPT and other prostaglandin transporters.

KIAA0880 proteins of the invention and nucleic acid molecules encoding them comprise a family of molecules having certain conserved structural and functional features, as indicated by its close homology to HPT (SEQ ID NO:116), the human OatP sodium-independent organic anion transporter protein (GenBank Accession no. P46721; SEQ ID NO:117), human 38555 protein (as described herein, SEQ ID NO:108), and human protein 593 (as described herein, SEQ ID NO:112).

KIAA0880 proteins typically comprise a variety of potential post-translational modification sites (often within an extracellular domain), such as those described herein in Table 53, as predicted by computerized sequence analysis of human KIAA0880 protein using amino acid sequence comparison software (comparing the amino acid sequence of protein KIAA0880 with the information in the PROSITE database {rel. 12.2; February, 1995} and the Hidden Markov Models database {Rel. PFAM 3.3}). In certain embodiments, a protein of the invention has at least 1, 2, 4, 6, 8, or 10 or more of the post-translational modification sites listed in Table 53.

TABLE 53

| Type of Potential Modification Site or Domain | Amino Acid Residues of SEQ ID NO:115 | Amino Acid Sequence |
|---|---|---|
| N-glycosylation site | 176 to 179 | NCSS |
| | 350 to 353 | NLTV |
| | 538 to 541 | NCSC |
| Protein kinase C phosphorylation site | 266 to 268 | TIK |
| | 337 to 339 | STK |
| | 367 to 369 | TLR |
| | 507 to 509 | STR |
| Casein kinase II phosphorylation site | 74 to 77 | STVE |
| | 92 to 95 | SFNE |
| | 147 to 150 | TSPE |
| | 179 to 182 | SYTE |
| | 212 to 215 | SYID |
| | 266 to 269 | TIKD |
| | 333 to 336 | SPGE |
| | 488 to 491 | SCME |
| | 508 to 511 | TRVE |
| | 620 to 623 | SAID |
| N-myristoylation site | 88 to 93 | GLLASF |
| | 129 to 134 | GLLMTL |
| | 175 to 180 | GNCSSY |
| | 228 to 233 | GILFAV |
| | 239 to 244 | GLAFGL |
| | 262 to 267 | GISLTI |
| | 424 to 429 | GIVVGG |
| | 449 to 454 | GMLLCL |
| | 551 to 556 | GSCDST |
| | 571 to 576 | GSALAC |
| | 661 to 666 | GSVICF |
| Amidation site | 633 to 636 | CGRR |
| | 700 to 703 | PGKK |
| Microbodies C-terminal targeting signal | 707 to 709 | SRV |

Protein KIAA0880 is predicted by computerized amino acid sequence analysis (using the MEMSAT computer program) to be a twelve-transmembrane region integral membrane protein having transmembrane regions at approximately the following positions within SEQ ID NO:115: from about amino acid residue 50 to about residue 69; from about amino acid residue 88 to about residue 108; from about amino acid residue 117 to about residue 134; from about amino acid residue 186 to about residue 206; from about amino acid residue 225 to about residue 249; from about amino acid residue 276 to about residue 297; from about amino acid residue 372 to about residue 394; from about amino acid residue 411 to about residue 432; from about amino acid residue 440 to about residue 463; from about amino acid residue 564 to about residue 587; from about amino acid residue 596 to about residue 612; and from about amino acid residue 651 to about residue 673

Extracellular domains are predicted to include approximately amino acid residues 70 to 87, 135 to 185, 250 to 275, 395 to 410, 464 to 563, and 613 to 650 of SEQ ID NO:115. Intracellular domains are predicted to include approximately amino acid residues 1 to 49, 109 to 116, 207 to 224, 298 to 371, 433 to 439, 588 to 595, and 674 to 709 of SEQ ID NO:115.

As described elsewhere herein, relatively hydrophilic regions are generally located at or near the surface of a protein, and are more frequently effective immunogenic epitopes than are relatively hydrophobic regions. For example, the region of human protein KIAA0880 from about amino acid residue 135 to about amino acid residue 155 appears to be located at or near the surface of the protein, while the region from about amino acid residue 160 to about amino acid residue 165 appears not to be located at or near the surface.

Human protein KIAA0880 exhibits sequence similarity to HPT (GenBank Accession no. Q92959; SEQ ID NO:117). An alignment between KIAA0880 (SEQ ID NO:115 and HPT (SEQ ID NO:117), made using the ALIGN program of the GCG software package, pam120.mat scoring matrix, gap penalties −12/−4, reveals that the amino acid sequences of the proteins are 39.5% identical.

The predicted molecular weight of human protein KIAA0880 is about 76.7 kilodaltons.

Biological Function of Human KIAA0880 Proteins, Nucleic Acids Encoding Them, and Modulators of These Molecules Human KIAA0880 protein is involved in disorders which affect both tissues in which they are normally expressed and tissues in which they are normally not expressed. Based on the observation by others that KIAA0880 protein is expressed in human brain tissue and on the function of this protein as identified herein, human KIAA0880 protein is involved in one or more biological processes which occur in brain and other neurological tissues. In particular, KIAA0880 is involved in modulating growth, proliferation, survival, differentiation, and activity of cells including, but not limited to, central nervous system neurons, peripheral nervous system neurons, motor neurons, sensory neurons, and sympathetic and parasympathetic neural cells of the animal in which it is normally expressed. Protein KIAA0880 is also involved in mediating interactions between cells, particularly between two neurons, or between a neuron and a non-neuronal cell such as a muscle or endocrine cell. Thus, KIAA0880 protein has a role in disorders which affect neuronal cells and cells which interact with neurons and their growth, proliferation, survival, differentiation, and activity.

Widespread expression of KIAA0880 has been detected among human tissue types. Thus, the growth-, proliferation-, survival-, differentiation-, and activity-modulating activities of KIAA0880 protein affect cells of many types. Thus, protein KIAA0880 can affect cell-to-cell interactions in a wide variety of cell types.

Protein KIAA0880 is involved in transmembrane transport of one or more charged organic compounds such as prostaglandins, thromboxanes, and the like. Protein KIAA0880 mediates one or more of facilitated diffusion of the prostaglandin (or thromboxane or the like) and symport or antiport (e.g. involving co-transport of a proton, a sodium ion, a potassium ion, or another physiological ion).

Protein KIAA0880 is therefore involved in transmembrane transport of charged organic molecules such as one or more prostaglandins and thromboxanes in brain and other neural tissues in humans, and is thus involved in, and can be used to prognosticate, prevent, diagnose, or treat, one or more disorders related to inappropriate transmembrane transport (i.e. including inappropriate failure of transport) of prostaglandins, thromboxanes, and the like in neural tissues. Such disorders include, by way of example, neural transmission disorders (e.g. inappropriate pain, dementia, multiple sclerosis, nerve root disorders, Alzheimer's disease, Parkinson's disease, depression, physical and psychological substance addiction, sexual dysfunction, schizophrenic disorders, delusional disorders, mood disorders, sleep disorders, and the like) and disorders relating to inappropriate formation (i.e. including failure to form) and maintenance (i.e. including deterioration) of neuronal synapses, including both neuron-to-neuron synapses and neuron-to-non-neuronal cell synapses. Thus, in addition to the neural transmission disorders described above, protein KIAA0880 is also implicated in, and can be used to prognosticate, prevent, diagnose, or treat, one or more disorders such as stroke, regeneration of chronically or traumatically damaged neuronal structures (including nerve, brain, and spinal cord), developmental neuronal disorders (e.g. spina bifida), neuronal cancers (e.g. gliomas, astrocytomas, ependymomas, pituitary adenomas, and the like), peripheral nerve deficit, coronary insufficiency, angina, and the like. Exemplary molecules which can be transported across cell membranes via protein KIAA0880 include one or more charged organic compounds such as prostaglandins $A_1$, $A_2$, $B_1$, $B_2$, $D_2$, $E_1$, $E_2$, $F_{1\alpha}$, $F_{2\alpha}$, $G_2$, $H_2$, $I_2$, and $J_2$ and thromboxanes $A_2$ and $B_2$. Uptake and release of prostaglandins and thromboxanes, for example, are known to be involved in a variety of physiological processes and disorders including glaucoma, ovum fertilization, sperm motility, pregnancy, labor, delivery, abortion, gastric protection, peptic ulcer formation, intestinal fluid secretion, liver protection, liver damage, liver fibrosis, pain stimulation, glomerular filtration, maintenance of body temperature, fever, airway resistance, asthma, chronic obstructive pulmonary disorder, modulation of blood pressure, hypertension, shock, modulation of inflammation, platelet aggregation, abnormal blood coagulation, atherosclerosis, arteriosclerosis, and coronary artery disease. Thus, polypeptides and nucleic acid molecules of the invention, and compounds which bind with or modulate one or more polypeptides and nucleic acid molecules of the invention can be used to prognosticate, diagnose, inhibit, or treat one or more of the disorders listed above or one or more disorders associated with the physiological processes listed above.

Biological Deposit

Clones encoding human 38555 and 593 proteins were deposited with ATCC on Jul. 22, 1999 in the form of a mixture of two plasmids, one (Ep65h2) encoding protein 38555, the other (Ep593) encoding protein 593. This deposit will be maintained under the terms of the Budapest Treaty on the International Recognition of the Deposit of Microorganisms for the Purposes of Patent Procedure.

In order to check for the presence of Ep65h2 and Ep593 in the deposited mixture, an *E. coli* host strain (e.g. DH5α) is transformed using the mixture and plated and incubated on Luria broth plates containing 100 micrograms per milliliter ampicillin. About 10 to 20 transformants are selected and subjected to a standard plasmid minipreparation procedure. Each DNA is digested using restriction endonuclease EcoRI and the fragments are separated by, for example, agarose gel electrophoresis. Fragments are visualized (e.g. using ethidium bromide in the agarose gel). EcoRI digestion of Ep62h5 yields one band approximately 5.5 kB in size. EcoRI digestion of Ep62h5 yields two bands, one having a size of about 3.5 kB, and the other having a size of about 1.5 kB.

This deposit was made merely as a convenience to those of skill in the art. This deposit is not an admission that a deposit is required pursuant to 35 U.S.C. §112.

Definitions

The 21910, 56634, 55053, 2504, 15977, 14760, 25501, 17903, 3700, 21529, 26176, 26343, 56638, 18610, 33217, 21967, h1983, m1983, 38555 or 593 protein, fragments thereof, and derivatives and other variants of the sequence in SEQ ID NO:2, 6, 11, 19, 22, 25, 32, 40, 44, 47, 50, 55, 58, 64, 67, 72, 89, 105, 108 or 112 thereof are collectively referred to as "polypeptides or proteins of the invention" or "21910, 56634, 55053, 2504, 15977, 14760, 25501, 17903, 3700, 21529, 26176, 26343, 56638, 18610, 33217, 21967, h1983, m1983, 38555 or 593 polypeptides or proteins". Nucleic acid molecules encoding such polypeptides or proteins are collectively referred to as "nucleic acids of the invention" or "21910, 56634, 55053, 2504, 15977, 14760, 25501, 17903, 3700, 21529, 26176, 26343, 56638, 18610, 33217, 21967, h1983, m1983, 38555 or 593 nucleic acids."

As used herein, the term "nucleic acid molecule" includes DNA molecules (e.g., a cDNA or genomic DNA) and RNA molecules (e.g., an mRNA) and analogs of the DNA or RNA generated, e.g., by the use of nucleotide analogs. The nucleic acid molecule can be single-stranded or double-stranded, but preferably is double-stranded DNA.

The term "isolated or purified nucleic acid molecule" includes nucleic acid molecules which are separated from other nucleic acid molecules which are present in the natural source of the nucleic acid. For example, with regards to genomic DNA, the term "isolated" includes nucleic acid molecules which are separated from the chromosome with which the genomic DNA is naturally associated. Preferably, an "isolated" nucleic acid is free of sequences which naturally flank the nucleic acid (i.e., sequences located at the 5' and/or 3' ends of the nucleic acid) in the genomic DNA of the organism from which the nucleic acid is derived. For example, in various embodiments, the isolated nucleic acid molecule can contain less than about 5 kb, 4 kb, 3 kb, 2 kb, 1 kb, 0.5 kb or 0.1 kb of 5' and/or 3' nucleotide sequences which naturally flank the nucleic acid molecule in genomic DNA of the cell from which the nucleic acid is derived. Moreover, an "isolated" nucleic acid molecule, such as a cDNA molecule, can be substantially free of other cellular material or culture medium when produced by recombinant techniques, or substantially free of chemical precursors or other chemicals when chemically synthesized.

As used herein, the term "hybridizes under low stringency, medium stringency, high stringency, or very high stringency conditions" describes conditions for hybridization and washing. Guidance for performing hybridization reactions can be found in *Current Protocols in Molecular Biology* (1989) John Wiley & Sons, N.Y., 6.3.1-6.3.6, which is incorporated by reference. Aqueous and nonaqueous methods are described in that reference and either can be used. Specific hybridization conditions referred to herein are as follows: 1) low stringency hybridization conditions in 6× sodium chloride/sodium citrate (SSC) at about 45° C., followed by two washes in 0.2× SSC, 0.1% SDS at least at 50° C. (the temperature of the washes can be increased to 55° C. for low stringency conditions); 2) medium stringency hybridization conditions in 6×SSC at about 45° C., followed by one or more washes in 0.2×SSC, 0.1% SDS at 60° C.; 3) high stringency hybridization conditions in 6×SSC at about 45° C., followed by one or more washes in 0.2×SSC, 0.1% SDS at 65° C.; and preferably 4) very high stringency hybridization conditions are 0.5M sodium phosphate, 7% SDS at 65° C., followed by one or more washes at 0.2×SSC, 1% SDS at 65° C. Very high stringency conditions (4) are the preferred conditions and the ones that should be used unless otherwise specified.

As used herein, a "naturally-occurring" nucleic acid molecule refers to an RNA or DNA molecule having a nucleotide sequence that occurs in nature (e.g., encodes a natural protein).

As used herein, the terms "gene" and "recombinant gene" refer to nucleic acid molecules which include an open reading frame encoding a 21910, 56634, 55053, 2504, 15977, 14760, 25501, 17903, 3700, 21529, 26176, 26343, 56638, 18610, 33217, 21967, h1983, m1983, 38555 or 593 protein, preferably a mammalian 21910, 56634, 55053, 2504, 15977, 14760, 25501, 17903, 3700, 21529, 26176, 26343, 56638, 18610, 33217, 21967, h1983, m1983, 38555 or 593 protein, and can further include non-coding regulatory sequences, and introns.

An "isolated" or "purified" polypeptide or protein is substantially free of cellular material or other contaminating proteins from the cell or tissue source from which the protein is derived, or substantially free from chemical precursors or other chemicals when chemically synthesized. In one embodiment, the language "substantially free" means preparation of 21910, 56634, 55053, 2504, 15977, 14760, 25501, 17903, 3700, 21529, 26176, 26343, 56638, 18610, 33217, 21967, h1983, m1983, 38555 or 593 protein having less than about 30%, 20%, 10% and more preferably 5% (by dry weight), of non-21910, 56634, 55053, 2504, 15977, 14760, 25501, 17903, 3700, 21529, 26176, 26343, 56638, 18610, 33217, 21967, h1983, m1983, 38555 or 593 protein (also referred to herein as a "contaminating protein"), or of chemical precursors or non-21910, 56634, 55053, 2504, 15977, 14760, 25501, 17903, 3700, 21529, 26176, 26343, 56638, 18610, 33217, 21967, h1983, m1983, 38555 or 593 chemicals. When the 21910, 56634, 55053, 2504, 15977, 14760, 25501, 17903, 3700, 21529, 26176, 26343, 56638, 18610, 33217, 21967, h1983, m1983, 38555 or 593 protein or biologically active portion thereof is recombinantly produced, it is also preferably substantially free of culture medium, i.e., culture medium represents less than about 20%, more preferably less than about 10%, and most preferably less than about 5% of the volume of the protein preparation. The invention includes isolated or purified preparations of at least 0.01, 0.1, 1.0, and 10 milligrams in dry weight.

A "non-essential" amino acid residue is a residue that can be altered from the wild-type sequence of 21910, 56634, 55053, 2504, 15977, 14760, 25501, 17903, 3700, 21529, 26176, 26343, 56638, 18610, 33217, 21967, h1983, m1983, 38555 or 593 (e.g., the sequence of SEQ ID NO:1, 3, 5, 7, 10, 12, 18, 20, 21, 23, 24, 26, 31, 33, 39, 41, 43, 45, 46, 48, 49, 51, 54, 56, 57, 59, 63, 65, 66, 68, 71, 73, 88, 90, 104, 106, 107, 109, 111 or 113) without abolishing or more preferably, without substantially altering a biological activity, whereas an "essential" amino acid residue results in such a change. For example, amino acid residues that are conserved among the polypeptides of the present invention, e.g., those present in the conserved domains, are predicted to be particularly unamenable to alteration.

A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Thus, a predicted nonessential amino acid residue in a 21910, 56634, 55053, 2504, 15977, 14760, 25501, 17903, 3700, 21529, 26176, 26343, 56638, 18610, 33217, 21967, h1983, m1983, 38555 or 593 protein is preferably replaced with another amino acid residue from the same side chain family. Alternatively, in another embodiment, mutations can be introduced randomly along all or part of a 21910, 56634, 55053, 2504, 15977, 14760, 25501, 17903, 3700, 21529, 26176, 26343, 56638, 18610, 33217, 21967, h1983, m1983, 38555 or 593 coding sequence, such as by saturation mutagenesis, and the resultant mutants can be screened for 21910, 56634, 55053, 2504, 15977, 14760, 25501, 17903, 3700, 21529, 26176, 26343, 56638, 18610, 33217, 21967, h1983, m1983, 38555 or 593 biological activity to identify mutants that retain activity. Following mutagenesis of SEQ ID NO:1, 3, 5, 7, 10, 12, 18, 20, 21, 23, 24, 26, 31, 33, 39, 41, 43, 45, 46, 48, 49, 51, 54, 56, 57, 59, 63, 65, 66, 68, 71, 73, 88, 90, 104, 106, 107, 109, 111 or 113, the encoded protein can be expressed recombinantly and the activity of the protein can be determined.

As used herein, a "biologically active portion" of a 21910, 56634, 55053, 2504, 15977, 14760, 25501, 17903, 3700, 21529, 26176, 26343, 56638, 18610, 33217, 21967, h1983, m1983, 38555 or 593 protein includes a fragment of a 21910, 56634, 55053, 2504, 15977, 14760, 25501, 17903, 3700, 21529, 26176, 26343, 56638, 18610, 33217, 21967, h1983, m1983, 38555 or 593 protein which participates in an interaction between a 21910, 56634, 55053, 2504, 15977, 14760, 25501, 17903, 3700, 21529, 26176, 26343, 56638, 18610, 33217, 21967, h1983, m1983, 38555 or 593 molecule and a non-21910, 56634, 55053, 2504, 15977, 14760, 25501, 17903, 3700, 21529, 26176, 26343, 56638, 18610, 33217, 21967, h1983, m1983, 38555 or 593 molecule. Biologically active portions of a 21910, 56634, 55053, 2504, 15977, 14760, 25501, 17903, 3700, 21529, 26176, 26343, 56638, 18610, 33217, 21967, h1983, m1983, 38555 or 593 protein include peptides comprising amino acid sequences sufficiently homologous to or derived from the amino acid sequence of the 21910, 56634, 55053, 2504, 15977, 14760, 25501, 17903, 3700, 21529, 26176, 26343, 56638, 18610, 33217, 21967, h1983, m1983, 38555 or 593 protein, e.g., the amino acid sequence shown in SEQ ID NO:2, 6, 11, 19, 22, 25, 32, 40, 44, 47, 50, 55, 58, 64, 67, 72, 89, 105, 108 or 112, which include fewer amino acids than the full length 21910, 56634, 55053, 2504, 15977, 14760, 25501, 17903, 3700, 21529, 26176, 26343, 56638, 18610, 33217, 21967, h1983, m1983, 38555 or 593 protein, and exhibit at least one activity of a 21910, 56634, 55053, 2504, 15977, 14760, 25501, 17903, 3700, 21529, 26176, 26343, 56638, 18610, 33217, 21967, h1983, m1983, 38555 or 593 protein. Typically, biologically active portions comprise a domain or motif with at least one activity of the 21910, 56634, 55053, 2504, 15977, 14760, 25501, 17903, 3700, 21529, 26176, 26343, 56638, 18610, 33217, 21967, h1983, m1983, 38555 or 593 protein. A biologically active portion of a 21910, 56634, 55053, 2504, 15977, 14760, 25501, 17903, 3700, 21529, 26176, 26343, 56638, 18610, 33217, 21967, h1983, m1983, 38555 or 593 protein can be a polypeptide which is, for example, 10, 25, 50, 100, 200 or more amino acids in length. Biologically active portions of a 21910, 56634, 55053, 2504, 15977, 14760, 25501, 17903, 3700, 21529, 26176, 26343, 56638, 18610, 33217, 21967, h1983, m1983, 38555 or 593 protein can be used as targets for developing agents which modulate a 21910, 56634, 55053, 2504, 15977, 14760, 25501, 17903, 3700, 21529, 26176, 26343, 56638, 18610, 33217, 21967, h1983, m1983, 38555 or 593 mediated activity.

Calculations of homology or sequence identity (the terms "homology" and "identity" are used interchangeably herein) between sequences are performed as follows:

To determine the percent identity of two amino acid sequences, or of two nucleic acid sequences, the sequences are aligned for optimal comparison purposes (e.g., gaps can be introduced in one or both of a first and a second amino acid or nucleic acid sequence for optimal alignment and non-homologous sequences can be disregarded for comparison purposes). In a preferred embodiment, the length of a reference sequence aligned for comparison purposes is at least 30%, preferably at least 40%, more preferably at least 50%, even more preferably at least 60%, and even more preferably at least 70%, 80%, 90%, 100% of the length of the reference sequence. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position (as used herein amino acid or nucleic acid "identity" is equivalent to amino acid or nucleic acid "homology"). The percent identity between the two sequences is a function of the number of identical positions shared by the sequences, taking into account the number of gaps, and the length of each gap, which need to be introduced for optimal alignment of the two sequences.

The comparison of sequences and determination of percent identity between two sequences can be accomplished using a mathematical algorithm. In a preferred embodiment, the percent identity between two amino acid sequences is determined using the Needleman and Wunsch (1970) *J. Mol. Biol.* 48:444-453 algorithm which has been incorporated into the GAP program in the GCG software package using either a Blossum 62 matrix or a PAM250 matrix, and a gap weight of 16, 14, 12, 10, 8, 6, or 4 and a length weight of 1, 2, 3, 4, 5, or 6. In yet another preferred embodiment, the percent identity between two nucleotide sequences is determined using the GAP program in the GCG software package using a NWSgapdna.CMP matrix and a gap weight of 40, 50, 60, 70, or 80 and a length weight of 1, 2, 3, 4, 5, or 6. A particularly preferred set of parameters (and the one that should be used if the practitioner is uncertain about what parameters should be applied to determine if a molecule is within a sequence identity or homology limitation of the invention) are a Blossum 62 scoring matrix with a gap penalty of 12, a gap extend penalty of 4, and a frameshift gap penalty of 5.

The percent identity between two amino acid or nucleotide sequences can be determined using the algorithm of Meyers and Miller ((1989) CABIOS, 4:11-17) which has been incorporated into the ALIGN program (version 2.0), using a PAM120 weight residue table, a gap length penalty of 12 and a gap penalty of 4.

The nucleic acid and protein sequences described herein can be used as a "query sequence" to perform a search against public databases to, for example, identify other family members or related sequences. Such searches can be performed using the NBLAST and XBLAST programs (version 2.0) of Altschul et al. (1990) *J. Mol. Biol.* 215:403-10. BLAST nucleotide searches can be performed with the NBLAST program, score=100, wordlength=12 to obtain nucleotide sequences homologous to 21910, 56634, 55053, 2504, 15977, 14760, 25501, 17903, 3700, 21529, 26176, 26343, 56638, 18610, 33217, 21967, h1983, m1983, 38555 or 593 nucleic acid molecules of the invention. BLAST protein searches can be performed with the XBLAST program, score=50, wordlength=3 to obtain amino acid sequences homologous to 21910, 56634, 55053, 2504, 15977, 14760, 25501, 17903, 3700, 21529, 26176, 26343, 56638, 18610, 33217, 21967, h1983, m1983, 38555 or 593 protein molecules of the invention. To obtain gapped alignments for comparison purposes, Gapped BLAST can be utilized as described in Altschul et al., (1997) *Nucleic Acids Res.* 25:3389-3402. When utilizing BLAST and Gapped BLAST programs, the default parameters of the respective programs (e.g., XBLAST and NBLAST) can be used.

Particular 21910, 56634, 55053, 2504, 15977, 14760, 25501, 17903, 3700, 21529, 26176, 26343, 56638, 18610, 33217, 21967, h1983, m1983, 38555 or 593 polypeptides of the present invention have an amino acid sequence substantially identical to the amino acid sequence of SEQ ID NO:2, 6, 11, 19, 22, 25, 32, 40, 44, 47, 50, 55, 58, 64, 67, 72, 89, 105, 108 or 112. In the context of an amino acid sequence, the term "substantially identical" is used herein to refer to a first amino acid that contains a sufficient or minimum number of amino acid residues that are i) identical to, or ii) conservative substitutions of aligned amino acid residues in a second amino acid sequence such that the first and second amino acid sequences can have a common structural domain and/or common functional activity. For example, amino acid sequences that contain a common structural domain having at least about 60%, or 65% identity, likely 75% identity, more likely 85%, 90%. 91%, 92%, 93%, 94%, 95%, 96%, 97%, 98% or 99% identity to SEQ ID NO:2, 6, 11, 19, 22, 25, 32, 40, 44, 47, 50, 55, 58, 64, 67, 72, 89, 105, 108 or 112 are termed substantially identical.

In the context of nucleotide sequence, the term "substantially identical" is used herein to refer to a first nucleic acid sequence that contains a sufficient or minimum number of nucleotides that are identical to aligned nucleotides in a second nucleic acid sequence such that the first and second nucleotide sequences encode a polypeptide having common functional activity, or encode a common structural polypeptide domain or a common functional polypeptide activity. For example, nucleotide sequences having at least about 60%, or 65% identity, likely 75% identity, more likely 85%, 90%. 91%, 92%, 93%, 94%, 95%, 96%, 97%, 98% or 99% identity to SEQ ID NO:1, 3, 5, 7, 10, 12, 18, 20, 21, 23, 24, 26, 31, 33, 39, 41, 43, 45, 46, 48, 49, 51, 54, 56, 57, 59, 63, 65, 66, 68, 71, 73, 88, 90, 104, 106, 107, 109, 111 or 113 are termed substantially identical.

"Misexpression or aberrant expression", as used herein, refers to a non-wild type pattern of gene expression, at the RNA or protein level. It includes: expression at non-wild type levels, i.e., over or under expression; a pattern of expression that differs from wild type in terms of the time or stage at which the gene is expressed, e.g., increased or decreased expression (as compared with wild type) at a predetermined developmental period or stage; a pattern of expression that differs from wild type in terms of decreased expression (as compared with wild type) in a predetermined cell type or tissue type; a pattern of expression that differs from wild type in terms of the splicing size, amino acid sequence, post-transitional modification, or biological activity of the expressed polypeptide; a pattern of expression that differs from wild type in terms of the effect of an environmental stimulus or extracellular stimulus on expression of the gene, e.g., a pattern of increased or decreased expression (as compared with wild type) in the presence of an increase or decrease in the strength of the stimulus.

"Subject", as used herein, can refer to a mammal, e.g., a human, or to an experimental or animal or disease model. The subject can also be a non-human animal, e.g., a horse, cow, goat, or other domestic animal.

A "purified preparation of cells", as used herein, refers to, in the case of plant or animal cells, an in vitro preparation of cells and not an entire intact plant or animal. In the case of cultured cells or microbial cells, it consists of a preparation of at least 10% and more preferably 50% of the subject cells.

As used herein, cellular proliferative and/or differentiative disorders include cancer, e.g., carcinoma, sarcoma, metastatic disorders or hematopoietic neoplastic disorders, e.g., leukemias. A metastatic tumor can arise from a multitude of primary tumor types, including but not limited to those of prostate, colon, lung, breast and liver origin.

As used herein, the term "cancer" (also used interchangeably with the terms, "hyperproliferative" and "neoplastic") refers to cells having the capacity for autonomous growth, i.e., an abnormal state or condition characterized by rapidly proliferating cell growth. Cancerous disease states may be categorized as pathologic, i.e., characterizing or constituting a disease state, e.g., malignant tumor growth, or may be categorized as non-pathologic, i.e., a deviation from normal but not associated with a disease state, e.g., cell proliferation associated with wound repair. The term is meant to include all types of cancerous growths or oncogenic processes, metastatic tissues or malignantly transformed cells, tissues, or organs, irrespective of histopathologic type or stage of invasiveness. The term "cancer" includes malignancies of the various organ systems, such as those affecting lung, breast, cervix, ovary, thyroid, lymphoid, gastrointestinal, and genitourinary tract, as well as adenocarcinomas which include malignancies such as most colon cancers, renal-cell carcinoma, prostate cancer and/or testicular tumors, non-small cell carcinoma of the lung, cancer of the small intestine and cancer of the esophagus. The term "carcinoma" is art recognized and refers to malignancies of epithelial or endocrine tissues including respiratory system carcinomas, gastrointestinal system carcinomas, genitourinary system carcinomas, testicular carcinomas, breast carcinomas, prostatic carcinomas, endocrine system carcinomas, and melanomas. Exemplary carcinomas include those forming from tissue of the cervix, lung, prostate, breast, head and neck, colon and ovary. The term "carcinoma" also includes carcinosarcomas, e.g., which include malignant tumors composed of carcinomatous and sarcomatous tissues. An "adenocarcinoma" refers to a carcinoma derived from glandular tissue or in which the tumor cells form recognizable glandular structures. The term "sarcoma" is art recognized and refers to malignant tumors of mesenchymal derivation.

Examples of cellular proliferative and/or differentiative disorders of the lung include, but are not limited to, tumors such as bronchogenic carcinoma, including paraneoplastic syndromes, bronchioloalveolar carcinoma, neuroendocrine tumors, such as bronchial carcinoid, miscellaneous tumors, metastatic tumors, and pleural tumors, including solitary fibrous tumors (pleural fibroma) and malignant mesothelioma.

Examples of cellular proliferative and/or differentiative disorders of the breast include, but are not limited to, proliferative breast disease including, e.g., epithelial hyperplasia, sclerosing adenosis, and small duct papillomas; tumors, e.g., stromal tumors such as fibroadenoma, phyllodes tumor, and sarcomas, and epithelial tumors such as large duct papilloma; carcinoma of the breast including in situ (noninvasive) carcinoma that includes ductal carcinoma in situ (including Paget's disease) and lobular carcinoma in situ, and invasive (infiltrating) carcinoma including, but not limited to, invasive ductal carcinoma, invasive lobular carcinoma, medullary carcinoma, colloid (mucinous) carcinoma, tubular carcinoma, and invasive papillary carcinoma, and miscellaneous malignant neoplasms. Disorders in the male breast include, but are not limited to, gynecomastia and carcinoma.

Examples of cellular proliferative and/or differentiative disorders involving the colon include, but are not limited to, tumors of the colon, such as non-neoplastic polyps, adenomas, familial syndromes, colorectal carcinogenesis, colorectal carcinoma, and carcinoid tumors.

Examples of cancers or neoplastic conditions, in addition to the ones described above, include, but are not limited to, a fibrosarcoma, myosarcoma, liposarcoma, chondrosarcoma, osteogenic sarcoma, chordoma, angiosarcoma, endotheliosarcoma, lymphangiosarcoma, lymphangioendotheliosarcoma, synovioma, mesothelioma, Ewing's tumor, leiomyosarcoma, rhabdomyosarcoma, gastric cancer, esophageal cancer, rectal cancer, pancreatic cancer, ovarian cancer, prostate cancer, uterine cancer, cancer of the head and neck, skin cancer, brain cancer, squamous cell carcinoma, sebaceous gland carcinoma, papillary carcinoma, papillary adenocarcinoma, cystadenocarcinoma, medullary carcinoma, bronchogenic carcinoma, renal cell carcinoma, hepatoma, bile duct carcinoma, choriocarcinoma, seminoma, embryonal carcinoma, Wilm's tumor, cervical cancer, testicular cancer, small cell lung carcinoma, non-small cell lung carcinoma, bladder carcinoma, epithelial carcinoma, glioma, astrocytoma, medulloblastoma, craniopharyngioma, ependymoma, pinealoma, hemangioblastoma, acoustic neuroma, oligodendroglioma, meningioma, melanoma, neuroblastoma, retinoblastoma, leukemia, lymphoma, or Kaposi sarcoma.

Proliferative disorders include hematopoietic neoplastic disorders. As used herein, the term "hematopoietic neoplastic disorders" includes diseases involving hyperplastic/neoplastic cells of hematopoietic origin, e.g., arising from myeloid, lymphoid or erythroid lineages, or precursor cells thereof. Preferably, the diseases arise from poorly differentiated acute leukemias, e.g., erythroblastic leukemia and acute megakaryoblastic leukemia. Additional exemplary myeloid disorders include, but are not limited to, acute promyeloid leukemia (APML), acute myelogenous leukemia (AML) and chronic myelogenous leukemia (CML) (reviewed in Vaickus (1991) *Crit Rev. in Oncol./Hemotol.* 11:267-97); lymphoid malignancies include, but are not limited to acute lymphoblastic leukemia (ALL) which includes B-lineage ALL and T-lineage ALL, chronic lymphocytic leukemia (CLL), prolymphocytic leukemia (PLL), hairy cell leukemia (HLL) and Waldenstrom's macroglobulinemia (WM). Additional forms of malignant lymphomas include, but are not limited to non-Hodgkin lymphoma and variants thereof, peripheral T cell lymphomas, adult T cell leukemia/lymphoma (ATL), cutaneous T-cell lymphoma (CTCL), large granular lymphocytic leukemia (LGF), Hodgkin's disease and Reed-Sternberg disease.

As used herein, disorders of the breast include, but are not limited to, disorders of development; inflammations, including but not limited to, acute mastitis, periductal mastitis, periductal mastitis (recurrent subareolar abscess, squamous metaplasia of lactiferous ducts), mammary duct ectasia, fat necrosis, granulomatous mastitis, and pathologies associated with silicone breast implants; fibrocystic changes; proliferative breast disease including, but not limited to, epithelial hyperplasia, sclerosing adenosis, and small duct papillomas; tumors including, but not limited to, stromal tumors such as fibroadenoma, phyllodes tumor, and sarcomas, and epithelial tumors such as large duct papilloma; carcinoma of the breast including in situ (noninvasive) carcinoma that includes ductal carcinoma in situ (including Paget's disease) and lobular carcinoma in situ, and invasive (infiltrating) carcinoma including, but not limited to, invasive ductal carcinoma, no special type, invasive lobular carcinoma, medullary carcinoma, colloid (mucinous) carcinoma, tubular carcinoma, and invasive papillary carcinoma, and miscellaneous malignant neoplasms. Disorders in the male breast include, but are not limited to, gynecomastia and carcinoma.

As used herein, disorders involving the colon include, but are not limited to, congenital anomalies, such as atresia and stenosis, Meckel diverticulum, congenital aganglionic megacolon-Hirschsprung disease; enterocolitis, such as diarrhea and dysentery, infectious enterocolitis, including viral gastroenteritis, bacterial enterocolitis, necrotizing enterocolitis, antibiotic-associated colitis (pseudomembranous colitis), and collagenous and lymphocytic colitis, miscellaneous intestinal inflammatory disorders, including parasites and protozoa, acquired immunodeficiency syndrome, transplantation, drug-induced intestinal injury, radiation enterocolitis, neutropenic colitis (typhlitis), and diversion colitis; idiopathic inflammatory bowel disease, such as Crohn disease and ulcerative colitis; tumors of the colon, such as non-neoplastic polyps, adenomas, familial syndromes, colorectal carcinogenesis, colorectal carcinoma, and carcinoid tumors.

As used herein, disorders involving the kidney (or renal disorders) include, but are not limited to, congenital anomalies including, but not limited to, cystic diseases of the kidney, that include but are not limited to, cystic renal dysplasia, autosomal dominant (adult) polycystic kidney disease, autosomal recessive (childhood) polycystic kidney disease, and cystic diseases of renal medulla, which include, but are not limited to, medullary sponge kidney, and nephronophthisis-uremic medullary cystic disease complex, acquired (dialysis-associated) cystic disease, such as simple cysts; glomerular diseases including pathologies of glomerular injury that include, but are not limited to, in situ immune complex deposition, that includes, but is not limited to, anti-GBM nephritis, Heymann nephritis, and antibodies against planted antigens, circulating immune complex nephritis, antibodies to glomerular cells, cell-mediated immunity in glomerulonephritis, activation of alternative complement pathway, epithelial cell injury, and pathologies involving mediators of glomerular injury including cellular and soluble mediators, acute glomerulonephritis, such as acute proliferative (poststreptococcal, postinfectious) glomerulonephritis, including but not limited to, poststreptococcal glomerulonephritis and nonstreptococcal acute glomerulonephritis, rapidly progressive (crescentic) glomerulonephritis, nephrotic syndrome, membranous glomerulonephritis (membranous nephropathy), minimal change disease (lipoid nephrosis), focal segmental glomerulosclerosis, membranoproliferative glomerulonephritis, IgA nephropathy (Berger disease), focal proliferative and necrotizing glomerulonephritis (focal glomerulonephritis), hereditary nephritis, including but not limited to, Alport syndrome and thin membrane disease (benign familial hematuria), chronic glomerulonephritis, glomerular lesions associated with systemic disease, including but not limited to, systemic lupus erythematosus, Henoch-Schönlein purpura, bacterial endocarditis, diabetic glomerulosclerosis, amyloidosis, fibrillary and immunotactoid glomerulonephritis, and other systemic disorders; diseases affecting tubules and interstitium, including acute tubular necrosis and tubulointerstitial nephritis, including but not limited to, pyelonephritis and urinary tract infection, acute pyelonephritis, chronic pyelonephritis and reflux nephropathy, and tubulointerstitial nephritis induced by drugs and toxins, including but not limited to, acute drug-induced interstitial nephritis, analgesic abuse nephropathy, nephropathy associated with nonsteroidal anti-inflammatory drugs, and other tubulointerstitial diseases including, but not limited to, urate nephropathy, hypercalcemia and nephrocalcinosis, and multiple myeloma; diseases of blood vessels including benign nephrosclerosis, malignant hypertension and accelerated nephrosclerosis, renal artery stenosis, and thrombotic microangiopathies including, but not limited to, classic (childhood) hemolytic-uremic syndrome, adult hemolytic-uremic syndrome/thrombotic thrombocytopenic purpura, idiopathic HUS/TTP, and other vascular disorders including, but not limited to, atherosclerotic ischemic renal disease, atheroembolic renal disease, sickle cell disease nephropathy, diffuse cortical necrosis, and renal infarcts; urinary tract obstruction (obstructive uropathy); urolithiasis (renal calculi, stones); and tumors of the kidney including, but not limited to, benign tumors, such as renal papillary adenoma, renal fibroma or hamartoma (renomedullary interstitial cell tumor), angiomyolipoma, and oncocytoma, and malignant tumors, including renal cell carcinoma (hypernephroma, adenocarcinoma of kidney), which includes urothelial carcinomas of renal pelvis.

Examples of disorders of the lung include, but are not limited to, congenital anomalies; atelectasis; diseases of vascular origin, such as pulmonary congestion and edema, including hemodynamic pulmonary edema and edema caused by microvascular injury, adult respiratory distress syndrome (diffuse alveolar damage), pulmonary embolism, hemorrhage, and infarction, and pulmonary hypertension and vascular sclerosis; chronic obstructive pulmonary disease, such as emphysema, chronic bronchitis, bronchial asthma, and bronchiectasis; diffuse interstitial (infiltrative, restrictive) diseases, such as pneumoconioses, sarcoidosis, idiopathic pulmonary fibrosis, desquamative interstitial pneumonitis, hypersensitivity pneumonitis, pulmonary eosinophilia (pulmonary infiltration with eosinophilia), *Bronchiolitis obliterans*-organizing pneumonia, diffuse pulmonary hemorrhage syndromes, including Goodpasture syndrome, idiopathic pulmonary hemosiderosis and other hemorrhagic syndromes, pulmonary involvement in collagen vascular disorders, and pulmonary alveolar proteinosis; complications of therapies, such as drug-induced lung disease, radiation-induced lung disease, and lung transplantation; tumors, such as bronchogenic carcinoma, including paraneoplastic syndromes, bronchioloalveolar carcinoma, neuroendocrine tumors, such as bronchial carcinoid, miscellaneous tumors, and metastatic tumors; pathologies of the pleura, including inflammatory pleural effusions, noninflammatory pleural effusions, pneumothorax, and pleural tumors, including solitary fibrous tumors (pleural fibroma) and malignant mesothelioma.

As used herein, disorders involving the pancreas include those of the exocrine pancreas such as congenital anomalies, including but not limited to, ectopic pancreas; pancreatitis, including but not limited to, acute pancreatitis; cysts, including but not limited to, pseudocysts; tumors, including but not limited to, cystic tumors and carcinoma of the pancreas; and disorders of the endocrine pancreas such as, diabetes mellitus; islet cell tumors, including but not limited to, insulinomas, gastrinomas, and other rare islet cell tumors.

As used herein, disorders involving the ovary include, for example, polycystic ovarian disease, Stein-leventhal syndrome, Pseudomyxoma peritonei and stromal hyperthecosis; ovarian tumors such as, tumors of coelomic epithelium, serous tumors, mucinous tumors, endometeriod tumors, clear cell adenocarcinoma, cystadenofibroma, brenner tumor, surface epithelial tumors; germ cell tumors such as mature (benign) teratomas, monodermal teratomas, immature malignant teratomas, dysgerminoma, endodermal sinus tumor, choriocarcinoma; sex cord-stomal tumors such as, granulosatheca cell tumors, thecoma-fibromas, androblastomas, hill cell tumors, and gonadoblastoma; and metastatic tumors such as Krukenberg tumors.

Aberrant expression and/or activity of the molecules of the invention can mediate disorders associated with bone metabolism. "Bone metabolism" refers to direct or indirect effects in the formation or degeneration of bone structures, e.g., bone formation, bone resorption, etc., which can ultimately affect the concentrations in serum of calcium and phosphate. This term also includes activities mediated by the molecules of the invention in bone cells, e.g. osteoclasts and osteoblasts, that can in turn result in bone formation and degeneration. For example, molecules of the invention can support different activities of bone resorbing osteoclasts such as the stimulation of differentiation of monocytes and mononuclear phagocytes into osteoclasts. Accordingly, molecules of the invention that modulate the production of bone cells can influence bone formation and degeneration, and thus can be used to treat bone disorders. Examples of such disorders include, but are not limited to, osteoporosis, osteodystrophy, osteomalacia, rickets, osteitis fibrosa cystica, renal osteodystrophy, osteosclerosis, anti-convulsant treatment, osteopenia, fibrogenesis-imperfecta ossium, secondary hyperparathyroidism, hypoparathyroidism, hyperparathyroidism, cirrhosis, obstructive jaundice, drug induced metabolism, medullary carcinoma, chronic renal disease, rickets, sarcoidosis, glucocorticoid antagonism, malabsorption syndrome, steatorrhea, tropical sprue, idiopathic hypercalcemia and milk fever.

As used herein, "a prostate disorder" refers to an abnormal condition occurring in the male pelvic region characterized by, e.g., male sexual dysfunction and/or urinary symptoms. This disorder may be manifested in the form of genitourinary inflammation (e.g., inflammation of smooth muscle cells) as in several common diseases of the prostate including prostatitis, benign prostatic hyperplasia and cancer, e.g., adenocarcinoma or carcinoma, of the prostate.

Examples of immune, e.g., inflammatory, (e.g. respiratory inflammatory) disorders or diseases include, but are not limited to, autoimmune diseases (including, for example, diabetes mellitus, arthritis (including rheumatoid arthritis, juvenile rheumatoid arthritis, osteoarthritis, psoriatic arthritis), multiple sclerosis, encephalomyelitis, myasthenia gravis, systemic lupus erythematosis, autoimmune thyroiditis, dermatitis (including atopic dermatitis and eczematous dermatitis), psoriasis, Sjögren's Syndrome, inflammatory bowel disease, e.g. Crohn's disease and ulcerative colitis, aphthous ulcer, iritis, conjunctivitis, keratoconjunctivitis, asthma, allergic asthma, chronic obstructive pulmonary disease, cutaneous lupus erythematosus, scleroderma, vaginitis, proctitis, drug eruptions, leprosy reversal reactions, erythema nodosum leprosum, autoimmune uveitis, allergic encephalomyelitis, acute necrotizing hemorrhagic encephalopathy, idiopathic bilateral progressive sensorineural hearing loss, aplastic anemia, pure red cell anemia, idiopathic thrombocytopenia, polychondritis, Wegener's granulomatosis, chronic active hepatitis, Stevens-Johnson syndrome, idiopathic sprue, lichen planus, Graves' disease, sarcoidosis, primary biliary cirrhosis, uveitis posterior, and interstitial lung fibrosis), graft-versus-host disease, cases of transplantation, and allergy such as, atopic allergy.

As used herein, disorders involving the heart, or "cardiovascular disease" or a "cardiovascular disorder" includes a disease or disorder which affects the cardiovascular system, e.g., the heart, the blood vessels, and/or the blood. A cardiovascular disorder can be caused by an imbalance in arterial pressure, a malfunction of the heart, or an occlusion of a blood vessel, e.g., by a thrombus. A cardiovascular disorder includes, but is not limited to disorders such as arteriosclerosis, atherosclerosis, cardiac hypertrophy, ischemia reperfusion injury, restenosis, arterial inflammation, vascular wall remodeling, ventricular remodeling, rapid ventricular pacing, coronary microembolism, tachycardia, bradycardia, pressure overload, aortic bending, coronary artery ligation, vascular heart disease, valvular disease, including but not limited to, valvular degeneration caused by calcification, rheumatic heart disease, endocarditis, or complications of artificial valves; atrial fibrillation, long-QT syndrome, congestive heart failure, sinus node dysfunction, angina, heart failure, hypertension, atrial fibrillation, atrial flutter, pericardial disease, including but not limited to, pericardial effusion and pericarditis; cardiomyopathies, e.g., dilated cardiomyopathy or idiopathic cardiomyopathy, myocardial infarction, coronary artery disease, coronary artery spasm, ischemic disease, arrhythmia, sudden cardiac death, and cardiovascular developmental disorders (e.g., arteriovenous malformations, arteriovenous fistulae, raynaud's syndrome, neurogenic thoracic outlet syndrome, causalgia/reflex sympathetic dystrophy, hemangioma, aneurysm, cavernous angioma, aortic valve stenosis, atrial septal defects, atrioventricular canal, coarctation of the aorta, ebsteins anomaly, hypoplastic left heart syndrome, interruption of the aortic arch, mitral valve prolapse, ductus arteriosus, patent foramen ovale, partial anomalous pulmonary venous return, pulmonary atresia with ventricular septal defect, pulmonary atresia without ventricular septal defect, persistance of the fetal circulation, pulmonary valve stenosis, single ventricle, total anomalous pulmonary venous return, transposition of the great vessels, tricuspid atresia, truncus arteriosus, ventricular septal defects). A cardiovascular disease or disorder also can include an endothelial cell disorder.

As used herein, disorders involving the brain include, but are not limited to, disorders involving neurons, and disorders involving glia, such as astrocytes, oligodendrocytes, ependymal cells, and microglia; cerebral edema, raised intracranial pressure and herniation, and hydrocephalus; malformations and developmental diseases, such as neural tube defects, forebrain anomalies, posterior fossa anomalies, and syringomyelia and hydromyelia; perinatal brain injury; cerebrovascular diseases, such as those related to hypoxia, ischemia, and infarction, including hypotension, hypoperfusion, and low-flow states—global cerebral ischemia and focal cerebral ischemia—infarction from obstruction of local blood supply, intracranial hemorrhage, including intracerebral (intraparenchymal) hemorrhage, subarachnoid hemorrhage and ruptured berry aneurysms, and vascular malformations, hypertensive cerebrovascular disease, including lacunar infarcts, slit hemorrhages, and hypertensive encephalopathy; infections, such as acute meningitis, including acute pyogenic (bacterial) meningitis and acute aseptic (viral) meningitis, acute focal suppurative infections, including brain abscess, subdural empyema, and extradural abscess, chronic bacterial meningoencephalitis, including tuberculosis and mycobacterioses, neurosyphilis, and neuroborreliosis (Lyme disease), viral meningoencephalitis, including arthropod-borne (Arbo) viral encephalitis, Herpes simplex virus Type 1, Herpes simplex virus Type 2, Varicella-zoster virus (Herpes zoster), cytomegalovirus, poliomyelitis, rabies, and human immunodeficiency virus 1, including HIV-1 meningoencephalitis (subacute encephalitis), vacuolar myelopathy, AIDS-associated myopathy, peripheral neuropathy, and AIDS in children, progressive multifocal leukoencephalopathy, subacute sclerosing panencephalitis, fungal meningoencephalitis, other infectious diseases of the nervous system; transmissible spongiform encephalopathies (prion diseases); demyelinating diseases, including multiple sclerosis, multiple sclerosis variants, acute disseminated encephalomyelitis and acute necrotizing hemorrhagic encephalomyelitis, and other diseases with demyelination; degenerative diseases, such as degenerative diseases affecting the cerebral cortex, including Alzheimer disease and Pick disease, degenerative diseases of basal ganglia and brain stem, including Parkinsonism, idiopathic Parkinson disease (paralysis agitans), progressive supranuclear palsy, corticobasal degenration, multiple system atrophy, including striatonigral degenration, Shy-Drager syndrome, and olivopontocerebellar atrophy, and Huntington disease; spinocerebellar degenerations, including spinocerebellar ataxias, including Friedreich ataxia, and ataxia-telangiectasia, degenerative diseases affecting motor neurons, including amyotrophic lateral sclerosis (motor neuron disease), bulbospinal atrophy (Kennedy syndrome), and spinal muscular atrophy; inborn errors of metabolism, such as leukodystrophies, including Krabbe disease, metachromatic leukodystrophy, adrenoleukodystrophy, Pelizaeus-Merzbacher disease, and Canavan disease, mitochondrial encephalomyopathies, including Leigh disease and other mitochondrial encephalomyopathies; toxic and acquired metabolic diseases, including vitamin deficiencies such as thiamine (vitamin $B_1$) deficiency and vitamin $B_{12}$ deficiency, neurologic sequelae of metabolic disturbances, including hypoglycemia, hyperglycemia, and hepatic encephalopathy, toxic disorders, including carbon monoxide, methanol, ethanol, and radiation, including combined methotrexate and radiation-induced injury; tumors, such as gliomas, including astrocytoma, including fibrillary (diffuse) astrocytoma and glioblastoma multiforme, pilocytic astrocytoma, pleomorphic xanthoastrocytoma, and brain stem glioma, oligodendroglioma, and ependymoma and related paraventricular mass lesions, neuronal tumors, poorly differentiated neoplasms, including medulloblastoma, other parenchymal tumors, including primary brain lymphoma, germ cell tumors, and pineal parenchymal tumors, meningiomas, metastatic tumors, paraneoplastic syndromes, peripheral nerve sheath tumors, including schwannoma, neurofibroma, and malignant peripheral nerve sheath tumor (malignant schwannoma), and neurocutaneous syndromes (phakomatoses), including neurofibromotosis, including Type 1 neurofibromatosis (NF1) and TYPE 2 neurofibromatosis (NF2), tuberous sclerosis, and Von Hippel-Lindau disease.

As used herein, skeletal muscle disorders include, but are not limited to, muscular dystrophy (e.g., Duchenne muscular dystrophy, Becker muscular dystrophy, Emery-Dreifuss muscular dystrophy, limb-girdle muscular dystrophy, facioscapulohumeral muscular dystrophy, myotonic dystrophy, oculopharyngeal muscular dystrophy, distal muscular dystrophy, and congenital muscular dystrophy), motor neuron diseases (e.g., amyotrophic lateral sclerosis, infantile progressive spinal muscular atrophy, intermediate spinal muscular atrophy, spinal bulbar muscular atrophy, and adult spinal muscular atrophy), myopathies (e.g., inflammatory myopathies (e.g., dermatomyositis and polymyositis), myotonia congenita, paramyotonia congenita, central core disease, nemaline myopathy, myotubular myopathy, and periodic paralysis), tumors such as rhabdomyosarcoma, and metabolic diseases of muscle (e.g., phosphorylase deficiency, acid maltase deficiency, phosphofructokinase deficiency, debrancher enzyme deficiency, mitochondrial myopathy, carnitine deficiency, carnitine palmityl transferase deficiency, phosphoglycerate kinase deficiency, phosphoglycerate mutase deficiency, lactate dehydrogenase deficiency, and myoadenylate deaminase deficiency).

As used herein, an "endothelial cell disorder" includes a disorder characterized by aberrant, unregulated, or unwanted endothelial cell activity, e.g., proliferation, migration, angiogenesis, or vascularization; or aberrant expression of cell surface adhesion molecules or genes associated with angiogenesis, e.g., TIE-2, FLT and FLK. Endothelial cell disorders include tumorigenesis, tumor metastasis, psoriasis, diabetic retinopathy, endometriosis, Grave's disease, ischemic disease (e.g., atherosclerosis), and chronic inflammatory diseases (e.g., rheumatoid arthritis).

Disorders involving the liver (hepatic disorders) include, but are not limited to, hepatic injury; jaundice and cholestasis, such as bilirubin and bile formation; hepatic failure and cirrhosis, such as cirrhosis, portal hypertension, including ascites, portosystemic shunts, and splenomegaly; infectious disorders, such as viral hepatitis, including hepatitis A-E infection and infection by other hepatitis viruses, clinicopathologic syndromes, such as the carrier state, asymptomatic infection, acute viral hepatitis, chronic viral hepatitis, and fulminant hepatitis; autoimmune hepatitis; drug- and toxin-induced liver disease, such as alcoholic liver disease; inborn errors of metabolism and pediatric liver disease, such as hemochromatosis, Wilson disease, $\alpha_1$-antitrypsin deficiency, and neonatal hepatitis; primary bile acid malabsorption; intrahepatic biliary tract disease, such as secondary biliary cirrhosis, primary biliary cirrhosis, primary sclerosing cholangitis, and anomalies of the biliary tree; circulatory disorders, such as impaired blood flow into the liver, including hepatic artery compromise and portal vein obstruction and thrombosis, impaired blood flow through the liver, including passive congestion and centrilobular necrosis and peliosis hepatis, hepatic vein outflow obstruction, including hepatic vein thrombosis (Budd-Chiari syndrome) and veno-occlusive disease; hepatic disease associated with pregnancy, such as preeclampsia and eclampsia, acute fatty liver of pregnancy, and intrehepatic cholestasis of pregnancy; hepatic complications of organ or bone marrow transplantation, such as drug toxicity after bone marrow transplantation, graft-versus-host disease and liver rejection, and nonimmunologic damage to liver allografts; tumors and tumorous conditions, such as nodular hyperplasias, adenomas, and malignant tumors, including primary carcinoma of the liver and metastatic tumors.

Disorders which can be treated or diagnosed by methods described herein include, but are not limited to, disorders associated with an accumulation in the liver of fibrous tissue, such as that resulting from an imbalance between production and degradation of the extracellular matrix accompanied by the collapse and condensation of preexisting fibers. The methods described herein can be used to diagnose or treat hepatocellular necrosis or injury induced by a wide variety of agents including processes which disturb homeostasis, such as an inflammatory process, tissue damage resulting from toxic injury or altered hepatic blood flow, and infections (e.g., bacterial, viral and parasitic). For example, the methods can be used for the early detection of hepatic injury, such as portal hypertension or hepatic fibrosis. In addition, the methods can be employed to detect liver fibrosis attributed to inborn errors of metabolism, for example, fibrosis resulting from a storage disorder such as Gaucher's disease (lipid abnormalities) or a glycogen storage disease, A1-antitrypsin deficiency; a disorder mediating the accumulation (e.g., storage) of an exogenous substance, for example, hemochromatosis (iron-overload syndrome) and copper storage diseases (Wilson's disease), disorders resulting in the accumulation of a toxic metabolite (e.g., tyrosinemia, fructosemia and galactosemia) and peroxisomal disorders (e.g., Zellweger syndrome). Additionally, the methods described herein can be used for the early detection and treatment of liver injury associated with the administration of various chemicals or drugs, such as for example, methotrexate, isonizaid, oxyphenisatin, methyldopa, chlorpromazine, tolbutamide or alcohol, or which represents a hepatic manifestation of a vascular disorder such as obstruction of either the intrahepatic or extrahepatic bile flow or an alteration in hepatic circulation resulting, for example, from chronic heart failure, veno-occlusive disease, portal vein thrombosis or Budd-Chiari syndrome.

Additionally, the molecules of the invention can play an important role in the etiology of certain viral diseases, including but not limited to Hepatitis B, Hepatitis C and Herpes Simplex Virus (HSV). Modulators of the activity of the molecules of the invention could be used to control viral diseases. The modulators can be used in the treatment and/or diagnosis of viral infected tissue or virus-associated tissue fibrosis, especially liver and liver fibrosis. Also, such modulators can be used in the treatment and/or diagnosis of virus-associated carcinoma, especially hepatocellular cancer.

Disorders related to reduced platelet number, thrombocytopenia, include idiopathic thrombocytopenic purpura, including acute idiopathic thrombocytopenic purpura, drug-induced thrombocytopenia, HIV-associated thrombocytopenia, and thrombotic microangiopathies: thrombotic thrombocytopenic purpura and hemolytic-uremic syndrome.

As used herein, neurological disorders include disorders of the central nervous system (CNS) and the peripheral nervous system, e.g., cognitive and neurodegenerative disorders, Examples of neurological disorders include, but are not limited to, autonomic function disorders such as hypertension and sleep disorders, and neuropsychiatric disorders, such as depression, schizophrenia, schizoaffective disorder, Korsakoff's psychosis, alcoholism, anxiety disorders, or phobic disorders; learning or memory disorders, e.g., amnesia or age-related memory loss, attention deficit disorder, dysthymic disorder, major depressive disorder, mania, obsessive-compulsive disorder, psychoactive substance use disorders, anxiety, phobias, panic disorder, as well as bipolar affective disorder, e.g., severe bipolar affective (mood) disorder (BP-1), and bipolar affective neurological disorders, e.g., migraine and obesity. Such neurological disorders include, for example, disorders involving neurons, and disorders involving glia, such as astrocytes, oligodendrocytes, ependymal cells, and microglia; cerebral edema, raised intracranial pressure and herniation, and hydrocephalus; malformations and developmental diseases, such as neural tube defects, forebrain anomalies, posterior fossa anomalies, and syringomyelia and hydromyelia; perinatal brain injury; cerebrovascular diseases, such as those related to hypoxia, ischemia, and infarction, including hypotension, hypoperfusion, and low-flow states—global cerebral ischemia and focal cerebral ischemia—infarction from obstruction of local blood supply, intracranial hemorrhage, including intracerebral (intraparenchymal) hemorrhage, subarachnoid hemorrhage and ruptured berry aneurysms, and vascular malformations, hypertensive cerebrovascular disease, including lacunar infarcts, slit hemorrhages, and hypertensive encephalopathy; infections, such as acute meningitis, including acute pyogenic (bacterial) meningitis and acute aseptic (viral) meningitis, acute focal suppurative infections, including brain abscess, subdural empyema, and extradural abscess, chronic bacterial meningoencephalitis, including tuberculosis and mycobacterioses, neurosyphilis, and neuroborreliosis (Lyme disease), viral meningoencephalitis, including arthropod-borne (Arbo) viral encephalitis, Herpes simplex virus Type 1, Herpes simplex virus Type 2, Varicella-zoster virus (Herpes zoster), cytomegalovirus, poliomyelitis, rabies, and human immunodeficiency virus 1, including HIV-1 meningoencephalitis (subacute encephalitis), vacuolar myelopathy, AIDS-associated myopathy, peripheral neuropathy, and AIDS in children, progressive multifocal leukoencephalopathy, subacute sclerosing panencephalitis, fungal meningoencephalitis, other infectious diseases of the nervous system; transmissible spongiform encephalopathies (prion diseases); demyelinating diseases, including multiple sclerosis, multiple sclerosis variants, acute disseminated encephalomyelitis and acute necrotizing hemorrhagic encephalomyelitis, and other diseases with demyelination; degenerative diseases, such as degenerative diseases affecting the cerebral cortex, including Alzheimer's disease and Pick's disease, degenerative diseases of basal ganglia and brain stem, including Parkinsonism, idiopathic Parkinson's disease (paralysis agitans) and other Lewy diffuse body diseases, progressive supranuclear palsy, corticobasal degenration, multiple system atrophy, including striatonigral degenration, Shy-Drager syndrome, and olivopontocerebellar atrophy, and Huntington's disease, senile dementia, Gilles de la Tourette's syndrome, epilepsy, and Jakob-Creutzfieldt disease; spinocerebellar degenerations, including spinocerebellar ataxias, including Friedreich ataxia, and ataxia-telanglectasia, degenerative diseases affecting motor neurons, including amyotrophic lateral sclerosis (motor neuron disease), bulbospinal atrophy (Kennedy syndrome), and spinal muscular atrophy; inborn errors of metabolism, such as leukodystrophies, including Krabbe disease, metachromatic leukodystrophy, adrenoleukodystrophy, Pelizaeus-Merzbacher disease, and Canavan disease, mitochondrial encephalomyopathies, including Leigh disease and other mitochondrial encephalomyopathies; toxic and acquired metabolic diseases, including vitamin deficiencies such as thiamine (vitamin $B_1$) deficiency and vitamin $B_{12}$ deficiency, neurologic sequelae of metabolic disturbances, including hypoglycemia, hyperglycemia, and hepatic encephatopathy, toxic disorders, including carbon monoxide, methanol, ethanol, and radiation, including combined methotrexate and radiation-induced injury; tumors, such as gliomas, including astrocytoma, including fibrillary (diffuse) astrocytoma and glioblastoma multiforme, pilocytic astrocytoma, pleomorphic xanthoastrocytoma, and brain stem glioma, oligodendroglioma, and ependymoma and related paraventricular mass lesions, neuronal tumors, poorly differentiated neoplasms, including medulloblastoma, other parenchymal tumors, including primary brain lymphoma, germ cell tumors, and pineal parenchymal tumors, meningiomas, metastatic tumors, paraneoplastic syndromes, peripheral nerve sheath tumors, including schwannoma, neurofibroma, and malignant peripheral nerve sheath tumor (malignant schwannoma), and neurocutaneous syndromes (phakomatoses), including neurofibromotosis, including Type 1 neurofibromatosis (NF1) and TYPE 2 neurofibromatosis (NF2), tuberous sclerosis, and Von Hippel-Lindau disease. Further CNS-related disorders include, for example, those listed in the American Psychiatric Association's Diagnostic and Statistical manual of Mental Disorders (DSM), the most current version of which is incorporated herein by reference in its entirety.

As used herein, diseases of the skin (dermal disorders), include but are not limited to, disorders of pigmentation and melanocytes, including but not limited to, vitiligo, freckle, melasma, lentigo, nevocellular nevus, dysplastic nevi, and malignant melanoma; benign epithelial tumors, including but not limited to, seborrheic keratoses, acanthosis nigricans, fibroepithelial polyp, epithelial cyst, keratoacanthoma, and adnexal (appendage) tumors; premalignant and malignant epidermal tumors, including but not limited to, actinic keratosis, squamous cell carcinoma, basal cell carcinoma, and merkel cell carcinoma; tumors of the dermis, including but not limited to, benign fibrous histiocytoma, dermatofibrosarcoma protuberans, xanthomas, and dermal vascular tumors; tumors of cellular immigrants to the skin, including but not limited to, histiocytosis X, mycosis fungoides (cutaneous T-cell lymphoma), and mastocytosis; disorders of epidermal maturation, including but not limited to, ichthyosis; acute inflammatory dermatoses, including but not limited to, urticaria, acute eczematous dermatitis, and erythema multiforme; chronic inflammatory dermatoses, including but not limited to, psoriasis, lichen planus, and lupus erythematosus; blistering (bullous) diseases, including but not limited to, pemphigus, bullous pemphigoid, dermatitis herpetiformis, and noninflammatory blistering diseases: epidermolysis bullosa and porphyria; disorders of epidermal appendages, including but not limited to, acne vulgaris; panniculitis, including but not limited to, erythema nodosum and erythema induratum; and infection and infestation, such as verrucae, molluscum contagiosum, impetigo, superficial fungal infections, and arthropod bites, stings, and infestations.

Additionally, molecules of the invention can play an important role in the regulation of metabolism or pain disorders. Diseases of metabolic imbalance include, but are not limited to, obesity, anorexia nervosa, cachexia, lipid disorders, and diabetes. Examples of pain disorders include, but are not limited to, pain response elicited during various forms of tissue injury, e.g., inflammation, infection, and ischemia, usually referred to as hyperalgesia (described in, for example, Fields (1987) *Pain*, New York:McGraw-Hill); pain associated with musculoskeletal disorders, e.g., joint pain; tooth pain; headaches; pain associated with surgery; pain related to irritable bowel syndrome; or chest pain.

As used herein, the term "erythroid associated disorders" include disorders involving aberrant (increased or deficient) erythroblast proliferation, e.g., an erythroleukemia, and aberrant (increased or deficient) erythroblast differentiation, e.g., an anemia. Erythrocyte-associated disorders include anemias such as, for example, drug- (chemotherapy-) induced anemias, hemolytic anemias due to hereditary cell membrane abnormalities, such as hereditary spherocytosis, hereditary elliptocytosis, and hereditary pyropoikilocytosis; hemolytic anemias due to acquired cell membrane defects, such as paroxysmal nocturnal hemoglobinuria and spur cell anemia; hemolytic anemias caused by antibody reactions, for example to the RBC antigens, or antigens of the ABO system, Lewis system, Ii system, Rh system, Kidd system, Duffy system, and Kell system; methemoglobinemia; a failure of erythropoiesis, for example, as a result of aplastic anemia, pure red cell aplasia, myelodysplastic syndromes, sideroblastic anemias, and congenital dyserythropoietic anemia; secondary anemia in non-hematolic disorders, for example, as a result of chemotherapy, alcoholism, or liver disease; anemia of chronic disease, such as chronic renal failure; and endocrine deficiency diseases. Another example of an erythroid-associated disorder is erythrocytosis. Erythrocytosis, a disorder of red blood cell overproduction caused by excessive and/or ectopic erythropoietin production, can be caused by cancers, e.g., a renal cell cancer, a hepatocarcinoma, and a central nervous system cancer. Diseases associated with erythrocytosis include polycythemias, e.g., polycythemia vera, secondary polycythemia, and relative polycythemia.

As used herein, an "angiogenesis disorder" includes a disease or disorder which affects or is caused by aberrant or deficient angiogenesis. Disorders involving angiogenesis include, but are not limited to, aberrant or excess angiogenesis in tumors such as hemangiomas and Kaposi's sarcoma, von Hippel-Lindau disease, as well as the angiogenesis associated with tumor growth; aberrant or excess angiogenesis in diseases such as a Castleman's disease or fibrodysplasia ossificans progressiva; aberrant or deficient angiogenesis associated with aging, complications of healing certain wounds and complications of diseases such as diabetes and rheumatoid arthritis; or aberrant or deficient angiogenesis associated with hereditary hemorrhagic telangiectasia, autosomal dominant polycystic kidney disease, myelodysplastic syndrome or Klippel-Trenaunay-Weber syndrome.

As used herein, disorders involving the spleen include, but are not limited to, splenomegaly, including nonspecific acute splenitis, congestive spenomegaly, and spenic infarcts; neoplasms, congenital anomalies, and rupture. Disorders associated with splenomegaly include infections, such as nonspecific splenitis, infectious mononucleosis, tuberculosis, typhoid fever, brucellosis, cytomegalovirus, syphilis, malaria, histoplasmosis, toxoplasmosis, kala-azar, trypanosomiasis, schistosomiasis, leishmaniasis, and echinococcosis; congestive states related to partial hypertension, such as cirrhosis of the liver, portal or splenic vein thrombosis, and cardiac failure; lymphohematogenous disorders, such as Hodgkin disease, non-Hodgkin lymphomas/leukemia, multiple myeloma, myeloproliferative disorders, hemolytic anemias, and thrombocytopenic purpura; immunologic-inflammatory conditions, such as rheumatoid arthritis and systemic lupus erythematosus; storage diseases such as Gaucher disease, Niemann-Pick disease, and mucopolysaccharidoses; and other conditions, such as amyloidosis, primary neoplasms and cysts, and secondary neoplasms.

As used herein, disorders involving blood vessels include, but are not limited to, responses of vascular cell walls to injury, such as endothelial dysfunction and endothelial activation and intimal thickening; vascular diseases including, but not limited to, congenital anomalies, such as arteriovenous fistula, atherosclerosis, and hypertensive vascular disease, such as hypertension; inflammatory disease—the vasculitides, such as giant cell (temporal) arteritis, Takayasu arteritis, polyarteritis nodosa (classic), Kawasaki syndrome (mucocutaneous lymph node syndrome), microscopic polyanglitis (microscopic polyarteritis, hypersensitivity or leukocytoclastic anglitis), Wegener granulomatosis, thromboanglitis obliterans (Buerger disease), vasculitis associated with other disorders, and infectious arteritis; Raynaud disease; aneurysms and dissection, such as abdominal aortic aneurysms, syphilitic (luetic) aneurysms, and aortic dissection (dissecting hematoma); disorders of veins and lymphatics, such as varicose veins, thrombophlebitis and phlebothrombosis, obstruction of superior vena cava (superior vena cava syndrome), obstruction of inferior vena cava (inferior vena cava syndrome), and lymphangitis and lymphedema; tumors, including benign tumors and tumor-like conditions, such as hemangioma, lymphangioma, glomus tumor (glomangioma), vascular ectasias, and bacillary angiomatosis, and intermediate-grade (borderline low-grade malignant) tumors, such as Kaposi sarcoma and hemangloendothelioma, and malignant tumors, such as angiosarcoma and hemangiopericytoma; and pathology of therapeutic interventions in vascular disease, such as balloon angioplasty and related techniques and vascular replacement, such as coronary artery bypass graft surgery.

As used herein, disorders involving the testis and epididymis include, but are not limited to, congenital anomalies such as cryptorchidism, regressive changes such as atrophy, inflammations such as nonspecific epididymitis and orchitis, granulomatous (autoimmune) orchitis, and specific inflammations including, but not limited to, gonorrhea, mumps, tuberculosis, and syphilis, vascular disturbances including torsion, testicular tumors including germ cell tumors that include, but are not limited to, seminoma, spermatocytic seminoma, embryonal carcinoma, yolk sac tumor choriocarcinoma, teratoma, and mixed tumors, tumore of sex cord-gonadal stroma including, but not limited to, Leydig (interstitial) cell tumors and sertoli cell tumors (androblastoma), and testicular lymphoma, and miscellaneous lesions of tunica vaginalis.

As used herein, disorders involving the thymus include developmental disorders, such as DiGeorge syndrome with thymic hypoplasia or aplasia; thymic cysts; thymic hypoplasia, which involves the appearance of lymphoid follicles within the thymus, creating thymic follicular hyperplasia; and thymomas, including germ cell tumors, lynphomas, Hodgkin disease, and carcinoids. Thymomas can include benign or encapsulated thymoma, and malignant thymoma Type I (invasive thymoma) or Type II, designated thymic carcinoma.

As used herein, disorders involving the thyroid include, but are not limited to, hyperthyroidism; hypothyroidism including, but not limited to, cretinism and myxedema; thyroiditis including, but not limited to, hashimoto thyroiditis, subacute (granulomatous) thyroiditis, and subacute lymphocytic (painless) thyroiditis; Graves disease; diffuse and multinodular goiter including, but not limited to, diffuse nontoxic (simple) goiter and multinodular goiter; neoplasms of the thyroid including, but not limited to, adenomas, other benign tumors, and carcinomas, which include, but are not limited to, papillary carcinoma, follicular carcinoma, medullary carcinoma, and anaplastic carcinoma; and cogenital anomalies.

As used herein, disorders related to reduced platelet number, thrombocytopenia, include idiopathic thrombocytopenic purpura, including acute idiopathic thrombocytopenic purpura, drug-induced thrombocytopenia, HIV-associated thrombocytopenia, and thrombotic microangiopathies: thrombotic thrombocytopenic purpura and hemolytic-uremic syndrome.

Various aspects of the invention are described in further detail below.

Isolated Nucleic Acid Molecules

In one aspect, the invention provides, an isolated or purified, nucleic acid molecule that encodes a 21910, 56634, 55053, 2504, 15977, 14760, 25501, 17903, 3700, 21529, 26176, 26343, 56638, 18610, 33217, 21967, h1983, m1983, 38555 or 593 polypeptide described herein, e.g., a full length 21910, 56634, 55053, 2504, 15977, 14760, 25501, 17903, 3700, 21529, 26176, 26343, 56638, 18610, 33217, 21967, h1983, m1983, 38555 or 593 protein or a fragment thereof, e.g., a biologically active portion of 21910, 56634, 55053, 2504, 15977, 14760, 25501, 17903, 3700, 21529, 26176, 26343, 56638, 18610, 33217, 21967, h1983, m1983, 38555 or 593 protein. Also included is a nucleic acid fragment suitable for use as a hybridization probe, which can be used, e.g., to identify a nucleic acid molecule encoding a polypeptide of the invention, 21910, 56634, 55053, 2504, 15977, 14760, 25501, 17903, 3700, 21529, 26176, 26343, 56638, 18610, 33217, 21967, h1983, m1983, 38555 or 593 mRNA, and fragments suitable for use as primers, e.g., PCR primers for the amplification or mutation of nucleic acid molecules.

In one embodiment, an isolated nucleic acid molecule of the invention includes the nucleotide sequence shown in SEQ ID NO:1, 3, 5, 7, 10, 12, 18, 20, 21, 23, 24, 26, 31, 33, 39, 41, 43, 45, 46, 48, 49, 51, 54, 56, 57, 59, 63, 65, 66, 68, 71, 73, 88, 90, 104, 106, 107, 109, 111 or 113, or a portion of any of this nucleotide sequence. In one embodiment, the nucleic acid molecule includes sequences encoding the human 21910, 56634, 55053, 2504, 15977, 14760, 25501, 17903, 3700, 21529, 26176, 26343, 56638, 18610, 33217, 21967, h1983, m1983, 38555 or 593 protein (i.e., "the coding region" of SEQ ID NO:1, 5, 10, 18, 21, 24, 31, 39, 43, 46, 49, 54, 57, 63, 66, 71, 88, 104, 107 or 111, as shown in SEQ ID NO:3, 7, 12, 20, 23, 26, 33, 41, 45, 48, 51, 56, 59, 65, 68, 73, 90, 106, 109 or 113, respectively), as well as 5' untranslated sequences and 3' untranslated sequences. Alternatively, the nucleic acid molecule can include only the coding region of SEQ ID NO:1, 5, 10, 18, 21, 24, 31, 39, 43, 46, 49, 54, 57, 63, 66, 71, 88, 104, 107 or 111 (e.g., SEQ ID NO:3, 7, 12, 20, 23, 26, 33, 41, 45, 48, 51, 56, 59, 65, 68, 73, 90, 106, 109 or 113) and, e.g., no flanking sequences which normally accompany the subject sequence. In another embodiment, the nucleic acid molecule encodes a sequence corresponding to a fragment of the protein corresponding to domains within SEQ ID NO:2, 6, 11, 19, 22, 25, 32, 40, 44, 47, 50, 55, 58, 64, 67, 72, 89, 105, 108 or 112.

In another embodiment, an isolated nucleic acid molecule of the invention includes a nucleic acid molecule which is a complement of the nucleotide sequence shown in SEQ ID NO:1, 3, 5, 7, 10, 12, 18, 20, 21, 23, 24, 26, 31, 33, 39, 41, 43, 45, 46, 48, 49, 51, 54, 56, 57, 59, 63, 65, 66, 68, 71, 73, 88, 90, 104, 106, 107, 109, 111 or 113, or a portion of any of these nucleotide sequences. In other embodiments, the nucleic acid molecule of the invention is sufficiently complementary to the nucleotide sequence shown in SEQ ID NO:1, 3, 5, 7, 10, 12, 18, 20, 21, 23, 24, 26, 31, 33, 39, 41, 43, 45, 46, 48, 49, 51, 54, 56, 57, 59, 63, 65, 66, 68, 71, 73, 88, 90, 104, 106, 107, 109, 111 or 113 such that it can hybridize to the nucleotide sequence shown in SEQ ID NO:1, 3, 5, 7, 10, 12, 18, 20, 21, 23, 24, 26, 31, 33, 39, 41, 43, 45, 46, 48, 49, 51, 54, 56, 57, 59, 63, 65, 66, 68, 71, 73, 88, 90, 104, 106, 107, 109, 111 or 113, thereby forming a stable duplex.

In one embodiment, an isolated nucleic acid molecule of the present invention includes a nucleotide sequence which is at least about: 60%, 65%, 70%, 75%, 80%, 85%, 90%, 91%, 92%, 93%, 94%, 95%, 96%, 97%, 98%, 99%, or more homologous to the entire length of the nucleotide sequence shown in SEQ ID NO:1, 3, 5, 7, 10, 12, 18, 20, 21, 23, 24, 26, 31, 33, 39, 41, 43, 45, 46, 48, 49, 51, 54, 56, 57, 59, 63, 65, 66, 68, 71, 73, 88, 90, 104, 106, 107, 109, 111 or 113, or a portion, preferably of the same length, of any of these nucleotide sequences.

21910, 56634, 55053, 2504, 15977, 14760, 25501, 17903, 3700, 21529, 26176, 26343, 56638, 18610, 33217, 21967, h1983, m1983, 38555 or 593 Nucleic Acid Fragments A nucleic acid molecule of the invention can include only a portion of the nucleic acid sequence of SEQ ID NO:1, 3, 5, 7, 10, 12, 18, 20, 21, 23, 24, 26, 31, 33, 39, 41, 43, 45, 46, 48, 49, 51, 54, 56, 57, 59, 63, 65, 66, 68, 71, 73, 88, 90, 104, 106, 107, 109, 111 or 113. For example, such a nucleic acid molecule can include a fragment which can be used as a probe or primer or a fragment encoding a portion of a 21910, 56634, 55053, 2504, 15977, 14760, 25501, 17903, 3700, 21529, 26176, 26343, 56638, 18610, 33217, 21967, h1983, m1983, 38555 or 593 protein, e.g., an immunogenic or biologically active portion of a 21910, 56634, 55053, 2504, 15977, 14760, 25501, 17903, 3700, 21529, 26176, 26343, 56638, 18610, 33217, 21967, h1983, m1983, 38555 or 593 protein. A fragment can comprise those nucleotides of SEQ ID NO:1, 3, 5, 7, 10, 12, 18, 20, 21, 23, 24, 26, 31, 33, 39, 41, 43, 45, 46, 48, 49, 51, 54, 56, 57, 59, 63, 65, 66, 68, 71, 73, 88, 90, 104, 106, 107, 109, 111 or 113, which encode a domain of human 21910, 56634, 55053, 2504, 15977, 14760, 25501, 17903, 3700, 21529, 26176, 26343, 56638, 18610, 33217, 21967, h1983, m1983, 38555 or 593. The nucleotide sequence determined from the cloning of the 21910, 56634, 55053, 2504, 15977, 14760, 25501, 17903, 3700, 21529, 26176, 26343, 56638, 18610, 33217, 21967, h1983, m1983, 38555 or 593 gene allows for the generation of probes and primers designed for use in identifying and/or cloning other 21910, 56634, 55053, 2504, 15977, 14760, 25501, 17903, 3700, 21529, 26176, 26343, 56638, 18610, 33217, 21967, h1983, m1983, 38555 or 593 family members, or fragments thereof, as well as 21910, 56634, 55053, 2504, 15977, 14760, 25501, 17903, 3700, 21529, 26176, 26343, 56638, 18610, 33217, 21967, h1983, m1983, 38555 or 593 homologs, or fragments thereof, from other species.

In another embodiment, a nucleic acid includes a nucleotide sequence that includes part, or all, of the coding region and extends into either (or both) the 5' or 3' noncoding region. Other embodiments include a fragment which includes a nucleotide sequence encoding an amino acid fragment described herein. Nucleic acid fragments can encode a specific domain or site described herein or fragments thereof, particularly fragments thereof which are at least 100 amino acids in length. Fragments also include nucleic acid sequences corresponding to specific amino acid sequences described above or fragments thereof. Nucleic acid fragments should not to be construed as encompassing those fragments that may have been disclosed prior to the invention.

A nucleic acid fragment can include a sequence corresponding to a domain, region, or functional site described herein. A nucleic acid fragment can also include one or more domain, region, or functional site described herein. Thus, for example, a 21910, 56634, 55053, 2504, 15977, 14760, 25501, 17903, 3700, 21529, 26176, 26343, 56638, 18610, 33217, 21967, h1983, m1983, 38555 or 593 nucleic acid fragment can include a sequence corresponding to a domain, as described herein.

21910, 56634, 55053, 2504, 15977, 14760, 25501, 17903, 3700, 21529, 26176, 26343, 56638, 18610, 33217, 21967, h1983, m1983, 38555 or 593 probes and primers are provided. Typically a probe/primer is an isolated or purified oligonucleotide. The oligonucleotide typically includes a region of nucleotide sequence that hybridizes under stringent conditions to at least about 7, 12 or 15, preferably about 20 or 25, more preferably about 30, 35, 40, 45, 50, 55, 60, 65, or 75 consecutive nucleotides of a sense or antisense sequence of SEQ ID NO:1, 3, 5, 7, 10, 12, 18, 20, 21, 23, 24, 26, 31, 33, 39, 41, 43, 45, 46, 48, 49, 51, 54, 56, 57, 59, 63, 65, 66, 68, 71, 73, 88, 90, 104, 106, 107, 109, 111 or 113, or of a naturally occurring allelic variant or mutant of SEQ ID NO:1, 3, 5, 7, 10, 12, 18, 20, 21, 23, 24, 26, 31, 33, 39, 41, 43, 45, 46, 48, 49, 51, 54, 56, 57, 59, 63, 65, 66, 68, 71, 73, 88, 90, 104, 106, 107, 109, 111 or 113.

In a preferred embodiment the nucleic acid is a probe which is at least 5 or 10, and less than 200, more preferably less than 100, or less than 50, base pairs in length. It should be identical, or differ by 1, or less than in 5 or 10 bases, from a sequence disclosed herein. If alignment is needed for this comparison the sequences should be aligned for maximum homology. "Looped" out sequences from deletions or insertions, or mismatches, are considered differences.

A probe or primer can be derived from the sense or antisense strand of a nucleic acid which encodes a domain identified in the 21910, 56634, 55053, 2504, 15977, 14760, 25501, 17903, 3700, 21529, 26176, 26343, 56638, 18610, 33217, 21967, h1983, m1983, 38555 or 593 sequences.

In another embodiment a set of primers is provided, e.g., primers suitable for use in a PCR, which can be used to amplify a selected region of a 21910, 56634, 55053, 2504, 15977, 14760, 25501, 17903, 3700, 21529, 26176, 26343, 56638, 18610, 33217, 21967, h1983, m1983, 38555 or 593 sequence, e.g., a domain, region, site or other sequence described herein. The primers should be at least 5, 10, or 50 base pairs in length and less than 100, or less than 200, base pairs in length. The primers should be identical, or differ by one base from a sequence disclosed herein or from a naturally occurring variant.

A nucleic acid fragment can encode an epitope bearing region of a polypeptide described herein.

A nucleic acid fragment encoding a "biologically active portion of a 21910, 56634, 55053, 2504, 15977, 14760, 25501, 17903, 3700, 21529, 26176, 26343, 56638, 18610, 33217, 21967, h1983, m1983, 38555 or 593 polypeptide" can be prepared by isolating a portion of the nucleotide sequence of SEQ ID NO:1, 3, 5, 7, 10, 12, 18, 20, 21, 23, 24, 26, 31, 33, 39, 41, 43, 45, 46, 48, 49, 51, 54, 56, 57, 59, 63, 65, 66, 68, 71, 73, 88, 90, 104, 106, 107, 109, 111 or 113, which encodes a polypeptide having a 21910, 56634, 55053, 2504, 15977, 14760, 25501, 17903, 3700, 21529, 26176, 26343, 56638, 18610, 33217, 21967, h1983, m1983, 38555 or 593 biological activity (e.g., the biological activities of the 21910, 56634, 55053, 2504, 15977, 14760, 25501, 17903, 3700, 21529, 26176, 26343, 56638, 18610, 33217, 21967, h1983, m1983, 38555 or 593 proteins are described herein), expressing the encoded portion of the 21910, 56634, 55053, 2504, 15977, 14760, 25501, 17903, 3700, 21529, 26176, 26343, 56638, 18610, 33217, 21967, h1983, m1983, 38555 or 593 protein (e.g., by recombinant expression in vitro) and assessing the activity of the encoded portion of the 21910, 56634, 55053, 2504, 15977, 14760, 25501, 17903, 3700, 21529, 26176, 26343, 56638, 18610, 33217, 21967, h1983, m1983, 38555 or 593 protein. A nucleic acid fragment encoding a biologically active portion of a 21910, 56634, 55053, 2504, 15977, 14760, 25501, 17903, 3700, 21529, 26176, 26343, 56638, 18610, 33217, 21967, h1983, m1983, 38555 or 593 polypeptide, can comprise a nucleotide sequence which is greater than 300 or more nucleotides in length.

In preferred embodiments, a nucleic acid includes a nucleotide sequence which is about 300, 400, 500, 600, 700, 800, 900, 1000, 1100, 1200, 1300, 1400, 1500, 1600, 1700, 1800, 1900, 2000, 2100, 2200, 2300, 2400, 2500, 2600, 2700, 2800, 2900, 3000, 3100, 3200, 3300, 3400, 3500, 3600, 3700, 3800, 3900, 4000, 4100, 4200, 4300, 4400, 4500, 4600, 4700, 4800, 4900, 5000, 5100, 5200, 5300, 5400, 5500, 5600, 5700, 5800, 5900, 6000, 6100, 6200, 6300, 6400, 6500, 6600, 6700, 6800, 6900, 7000, 7100, 7200, 7300 or more nucleotides in length and hybridizes under stringent hybridization conditions to a nucleic acid molecule of SEQ ID NO:1, 3, 5, 7, 10, 12, 18, 20, 21, 23, 24, 26, 31, 33, 39, 41, 43, 45, 46, 48, 49, 51, 54, 56, 57, 59, 63, 65, 66, 68, 71, 73, 88, 90, 104, 106, 107, 109, 111 or 113.

21910, 56634, 55053, 2504, 15977, 14760, 25501, 17903, 3700, 21529, 26176, 26343, 56638, 18610, 33217, 21967, h1983, m1983, 38555 or 593 Nucleic Acid Variants The invention further encompasses nucleic acid molecules that differ from the nucleotide sequence shown in SEQ ID NO:1, 3, 5, 7, 10, 12, 18, 20, 21, 23, 24, 26, 31, 33, 39, 41, 43, 45, 46, 48, 49, 51, 54, 56, 57, 59, 63, 65, 66, 68, 71, 73, 88, 90, 104, 106, 107, 109, 111 or 113. Such differences can be due to degeneracy of the genetic code (and result in a nucleic acid which encodes the same 21910, 56634, 55053, 2504, 15977, 14760, 25501, 17903, 3700, 21529, 26176, 26343, 56638, 18610, 33217, 21967, h1983, m1983, 38555 or 593 proteins as those encoded by the nucleotide sequence disclosed herein. In another embodiment, an isolated nucleic acid molecule of the invention has a nucleotide sequence encoding a protein having an amino acid sequence which differs, by at least 1, but less than 5, 10, 20, 50, or 100 amino acid residues that shown in SEQ ID NO:2, 6, 11, 19, 22, 25, 32, 40, 44, 47, 50, 55, 58, 64, 67, 72, 89, 105, 108 or 112. If alignment is needed for this comparison the sequences should be aligned for maximum homology. "Looped" out sequences from deletions or insertions, or mismatches, are considered differences.

Nucleic acids of the inventor can be chosen for having codons, which are preferred, or non-preferred, for a particular expression system. E.g., the nucleic acid can be one in which at least one codon, at preferably at least 10%, or 20% of the codons has been altered such that the sequence is optimized for expression in E. coli, yeast, human, insect, or CHO cells.

Nucleic acid variants can be naturally occurring, such as allelic variants (same locus), homologs (different locus), and orthologs (different organism) or can be non naturally occurring. Non-naturally occurring variants can be made by mutagenesis techniques, including those applied to polynucleotides, cells, or organisms. The variants can contain nucleotide substitutions, deletions, inversions and insertions. Variation can occur in either or both the coding and non-coding regions. The variations can produce both conservative and non-conservative amino acid substitutions (as compared in the encoded product).

In a preferred embodiment, the nucleic acid differs from that of SEQ ID NO:1, 3, 5, 7, 10, 12, 18, 20, 21, 23, 24, 26, 31, 33, 39, 41, 43, 45, 46, 48, 49, 51, 54, 56, 57, 59, 63, 65, 66, 68, 71, 73, 88, 90, 104, 106, 107, 109, 111 or 113, e.g., as follows: by at least one but less than 10, 20, 30, or 40 nucleotides; at least one but less than 1%, 5%, 10% or 20% of the nucleotides in the subject nucleic acid. If necessary for this analysis the sequences should be aligned for maximum homology. "Looped" out sequences from deletions or insertions, or mismatches, are considered differences.

Orthologs, homologs, and allelic variants can be identified using methods known in the art. These variants comprise a nucleotide sequence encoding a polypeptide that is 50%, at least about 55%, typically at least about 70-75%, more typically at least about 80-85%, and most typically at least about 90-95% or more identical to the nucleotide sequence shown in SEQ ID NO:1, 3, 5, 7, 10, 12, 18, 20, 21, 23, 24, 26, 31, 33, 39, 41, 43, 45, 46, 48, 49, 51, 54, 56, 57, 59, 63, 65, 66, 68, 71, 73, 88, 90, 104, 106, 107, 109, 111 or 113 or a fragment of this sequence. Such nucleic acid molecules can readily be identified as being able to hybridize under stringent conditions, to the nucleotide sequence shown in SEQ ID NO:1, 3, 5, 7, 10, 12, 18, 20, 21, 23, 24, 26, 31, 33, 39, 41, 43, 45, 46, 48, 49, 51, 54, 56, 57, 59, 63, 65, 66, 68, 71, 73, 88, 90, 104, 106, 107, 109, 111 or 113 or a fragment of the sequence. Nucleic acid molecules corresponding to orthologs, homologs, and allelic variants of the 21910, 56634, 55053, 2504, 15977, 14760, 25501, 17903, 3700, 21529, 26176, 26343, 56638, 18610, 33217, 21967, h1983, m1983, 38555 or 593 cDNAs of the invention can further be isolated by mapping to the same chromosome or locus as the 21910, 56634, 55053, 2504, 15977, 14760, 25501, 17903, 3700, 21529, 26176, 26343, 56638, 18610, 33217, 21967, h1983, m1983, 38555 or 593 gene.

Preferred variants include those that are correlated with activities specific to the molecules of the invention, i.e. guanylate kinase activity, phophatidylinositol 4-phosphate 5-kinase activity, kinase activity, transferase activity, aminopeptidase activity, adenylate cyclase activity, calpain protease activity, oxidoreductase activity, neprilysin protease activity, AMP binding enzyme activity and lysyl oxidase activity, or other activity.

Allelic variants of 21910, 56634, 55053, 2504, 15977, 14760, 25501, 17903, 3700, 21529, 26176, 26343, 56638, 18610, 33217, 21967, h1983, m1983, 38555 or 593, e.g., human 21910, 56634, 55053, 2504, 15977, 14760, 25501, 17903, 3700, 21529, 26176, 26343, 56638, 18610, 33217, 21967, h1983, m1983, 38555 or 593, include both functional and non-functional proteins. Functional allelic variants are naturally occurring amino acid sequence variants of the 21910, 56634, 55053, 2504, 15977, 14760, 25501, 17903, 3700, 21529, 26176, 26343, 56638, 18610, 33217, 21967, h1983, m1983, 38555 or 593 protein within a population that maintain the ability to bind a 21910, 56634, 55053, 2504, 15977, 14760, 25501, 17903, 3700, 21529, 26176, 26343, 56638, 18610, 33217, 21967, h1983, m1983, 38555 or 593 ligand or substrate and/or modulate cell proliferation and/or migration mechanisms. Functional allelic variants will typically contain only conservative substitution of one or more amino acids of SEQ ID NO:2, 6, 11, 19, 22, 25, 32, 40, 44, 47, 50, 55, 58, 64, 67, 72, 89, 105, 108 or 112, or substitution, deletion or insertion of non-critical residues in non-critical regions of the protein. Non-functional allelic variants are naturally-occurring amino acid sequence variants of the 21910, 56634, 55053, 2504, 15977, 14760, 25501, 17903, 3700, 21529, 26176, 26343, 56638, 18610, 33217, 21967, h1983, m1983, 38555 or 593, e.g., human 21910, 56634, 55053, 2504, 15977, 14760, 25501, 17903, 3700, 21529, 26176, 26343, 56638, 18610, 33217, 21967, h1983, m1983, 38555 or 593, protein within a population that do not have the ability to bind a 21910, 56634, 55053, 2504, 15977, 14760, 25501, 17903, 3700, 21529, 26176, 26343, 56638, 18610, 33217, 21967, h1983, m1983, 38555 or 593 ligand or substrate and/or modulate cell proliferation and/or migration mechanisms. Non-functional allelic variants will typically contain a non-conservative substitution, a deletion, or insertion, or premature truncation of the amino acid sequence of SEQ ID NO:2, 6, 11, 19, 22, 25, 32, 40, 44, 47, 50, 55, 58, 64, 67, 72, 89, 105, 108 or 112, or a substitution, insertion, or deletion in critical residues or critical regions of the protein.

Moreover, nucleic acid molecules encoding other 21910, 56634, 55053, 2504, 15977, 14760, 25501, 17903, 3700, 21529, 26176, 26343, 56638, 18610, 33217, 21967, h1983, m1983, 38555 or 593 family members and, thus, which have a nucleotide sequence which differs from the 21910, 56634, 55053, 2504, 15977, 14760, 25501, 17903, 3700, 21529, 26176, 26343, 56638, 18610, 33217, 21967, h1983, m1983, 38555 or 593 sequences of SEQ ID NO:1, 3, 5, 7, 10, 12, 18, 20, 21, 23, 24, 26, 31, 33, 39, 41, 43, 45, 46, 48, 49, 51, 54, 56, 57, 59, 63, 65, 66, 68, 71, 73, 88, 90, 104, 106, 107, 109, 111 or 113 are intended to be within the scope of the invention.

Antisense Nucleic Acid Molecules, Ribozymes and Modified 21910, 56634, 55053, 2504, 15977, 14760, 25501, 17903, 3700, 21529, 26176, 26343, 56638, 18610, 33217, 21967, h1983, m1983, 38555 or 593 Nucleic Acid Molecules In another aspect, the invention features, an isolated nucleic acid molecule which is antisense to 21910, 56634, 55053, 2504, 15977, 14760, 25501, 17903, 3700, 21529, 26176, 26343, 56638, 18610, 33217, 21967, h1983, m1983, 38555 or 593. An "antisense" nucleic acid can include a nucleotide sequence which is complementary to a "sense" nucleic acid encoding a protein, e.g., complementary to the coding strand of a double-stranded cDNA molecule or complementary to an mRNA sequence. The antisense nucleic acid can be complementary to an entire 21910, 56634, 55053, 2504, 15977, 14760, 25501, 17903, 3700, 21529, 26176, 26343, 56638, 18610, 33217, 21967, h1983, m1983, 38555 or 593 coding strand, or to only a portion thereof (e.g., the coding region of human 21910, 56634, 55053, 2504, 15977, 14760, 25501, 17903, 3700, 21529, 26176, 26343, 56638, 18610, 33217, 21967, h1983, m1983, 38555 or 593 corresponding to SEQ ID NO:3, 7, 12, 20, 23, 26, 33, 41, 45, 48, 51, 56, 59, 65, 68, 73, 90, 106, 109 or 113, respectively). In another embodiment, the antisense nucleic acid molecule is antisense to a "noncoding region" of the coding strand of a nucleotide sequence encoding 21910, 56634, 55053, 2504, 15977, 14760, 25501, 17903, 3700, 21529, 26176, 26343, 56638, 18610, 33217, 21967, h1983, m1983, 38555 or 593 (e.g., the 5' and 3' untranslated regions).

An antisense nucleic acid can be designed such that it is complementary to the entire coding region of 21910, 56634, 55053, 2504, 15977, 14760, 25501, 17903, 3700, 21529, 26176, 263431, 56638, 18610, 33217, 21967, h1983, m1983, 38555 or 593 mRNA, but more preferably is an oligonucleotide which is antisense to only a portion of the coding or noncoding region of 21910, 56634, 55053, 2504, 15977, 14760, 25501, 17903, 3700, 21529, 26176, 26343, 56638, 18610, 33217, 21967, h1983, m1983, 38555 or 593 mRNA. For example, the antisense oligonucleotide can be complementary to the region surrounding the translation start site of 21910, 56634, 55053, 2504, 15977, 14760, 25501, 17903, 3700, 21529, 26176, 26343, 56638, 18610, 33217, 21967, h1983, m1983, 38555 or 593 mRNA, e.g., between the −10 and +10 regions of the target gene nucleotide sequence of interest. An antisense oligonucleotide can be, for example, about 7, 10, 15, 20, 25, 30, 35, 40, 45, 50, 55, 60, 65, 70, 75, 80, or more nucleotides in length.

An antisense nucleic acid of the invention can be constructed using chemical synthesis and enzymatic ligation reactions using procedures known in the art. For example, an antisense nucleic acid (e.g., an antisense oligonucleotide) can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used. The antisense nucleic acid also can be produced biologically using an expression vector into which a nucleic acid has been subcloned in an antisense orientation (i.e., RNA transcribed from the inserted nucleic acid will be of an antisense orientation to a target nucleic acid of interest, described further in the following subsection).

The antisense nucleic acid molecules of the invention are typically administered to a subject (e.g., by direct injection at a tissue site), or generated in situ such that they hybridize with or bind to cellular mRNA and/or genomic DNA encoding a 21910, 56634, 55053, 2504, 15977, 14760, 25501, 17903, 3700, 21529, 26176, 26343, 56638, 18610, 33217, 21967, h1983, m1983, 38555 or 593 protein to thereby inhibit expression of the protein, e.g., by inhibiting transcription and/or translation. Alternatively, antisense nucleic acid molecules can be modified to target selected cells and then administered systemically. For systemic administration, antisense molecules can be modified such that they specifically or selectively bind to receptors or antigens expressed on a selected cell surface, e.g., by linking the antisense nucleic acid molecules to peptides or antibodies which bind to cell surface receptors or antigens. The antisense nucleic acid molecules can also be delivered to cells using the vectors described herein. To achieve sufficient intracellular concentrations of the antisense molecules, vector constructs in which the antisense nucleic acid molecule is placed under the control of a strong pol II or pol III promoter are preferred.

In yet another embodiment, the antisense nucleic acid molecule of the invention is an α-anomeric nucleic acid molecule. An α-anomeric nucleic acid molecule forms specific double-stranded hybrids with complementary RNA in which, contrary to the usual β-units, the strands run parallel to each other (Gaultier et al. (1987) *Nucleic Acids. Res.* 15:6625-6641). The antisense nucleic acid molecule can also comprise a 2'-o-methylribonucleotide (Inoue et al. (1987) *Nucleic Acids Res.* 15:6131-6148) or a chimeric RNA-DNA analogue (Inoue et al. (1987) *FEBS Lett.* 215:327-330).

In still another embodiment, an antisense nucleic acid of the invention is a ribozyme. A ribozyme having specificity for a 21910, 56634, 55053, 2504, 15977, 14760, 25501, 17903, 3700, 21529, 26176, 26343, 56638, 18610, 33217, 21967, h1983, m1983, 38555 or 593-encoding nucleic acid can include one or more sequences complementary to the nucleotide sequence of a 21910, 56634, 55053, 2504, 15977, 14760, 25501, 17903, 3700, 21529, 26176, 26343, 56638, 18610, 33217, 21967, h1983, m1983, 38555 or 593 cDNA disclosed herein (i.e., SEQ ID NO:1, 3, 5, 7, 10, 12, 18, 20, 21, 23, 24, 26, 31, 33, 39, 41, 43, 45, 46, 48, 49, 51, 54, 56, 57, 59, 63, 65, 66, 68, 71, 73, 88, 90, 104, 106, 107, 109, 111 or 113), and a sequence having known catalytic sequence responsible for mRNA cleavage (see U.S. Pat. No. 5,093,246 or Haselhoff and Gerlach (1988) *Nature* 334:585-591). For example, a derivative of a Tetrahymena L-19 IVS RNA can be constructed in which the nucleotide sequence of the active site is complementary to the nucleotide sequence to be cleaved in a 21910, 56634, 55053, 2504, 15977, 14760, 25501, 17903, 3700, 21529, 26176, 26343, 56638, 18610, 33217, 21967, h1983, m1983, 38555 or 593-encoding mRNA. See, e.g., Cech et al. U.S. Pat. No. 4,987,071; and Cech et al. U.S. Pat. No. 5,116,742. Alternatively, 21910, 56634, 55053, 2504, 15977, 14760, 25501, 17903, 3700, 21529, 26176, 26343, 56638, 18610, 33217, 21967, h1983, m1983, 38555 or 593 mRNA can be used to select a catalytic RNA having a specific ribonuclease activity from a pool of RNA molecules. See, e.g., Bartel and Szostak (1993) *Science* 261:1411-1418.

21910, 56634, 55053, 2504, 15977, 14760, 25501, 17903, 3700, 21529, 26176, 26343, 56638, 18610, 33217, 21967, h1983, m1983, 38555 or 593 gene expression can be inhibited by targeting nucleotide sequences complementary to the regulatory region of the 21910, 56634, 55053, 2504, 15977, 14760, 25501, 17903, 3700, 21529, 26176, 26343, 56638, 18610, 33217, 21967, h1983, m1983, 38555 or 593 (e.g., the 21910, 56634, 55053, 2504, 15977, 14760, 25501, 17903, 3700, 21529, 26176, 26343, 56638, 18610, 33217, 21967, h1983, m1983, 38555 or 593 promoter and/or enhancers) to form triple helical structures that prevent transcription of the 21910, 56634, 55053, 2504, 15977, 14760, 25501, 17903, 3700, 21529, 26176, 26343, 56638, 18610, 33217, 21967, h1983, m1983, 38555 or 593 gene in target cells. See generally, Helene (1991) *Anticancer Drug Des.* 6:569-84; Helene (1992) *Ann. N.Y. Acad. Sci.* 660:27-36; and Maher (1992) *Bioassays* 14:807-15. The potential sequences that can be targeted for triple helix formation can be increased by creating a so-called "switchback" nucleic acid molecule. Switchback molecules are synthesized in an alternating 5'-3', 3'-5' manner, such that they base pair with first one strand of a duplex and then the other, eliminating the necessity for a sizeable stretch of either purines or pyrimidines to be present on one strand of a duplex.

The invention also provides detectably labeled oligonucleotide primer and probe molecules. Typically, such labels are chemiluminescent, fluorescent, radioactive, or colorimetric.

A 21910, 56634, 55053, 2504, 15977, 14760, 25501, 17903, 3700, 21529, 26176, 26343, 56638, 18610, 33217, 21967, h1983, m1983, 38555 or 593 nucleic acid molecule can be modified at the base moiety, sugar moiety or phosphate backbone to improve, e.g., the stability, hybridization, or solubility of the molecule. For example, the deoxyribose phosphate backbone of the nucleic acid molecules can be modified to generate peptide nucleic acids (see Hyrup et al. (1996) *Bioorganic & Medicinal Chemistry* 4: 5-23).

As used herein, the terms "peptide nucleic acid" or "PNA" refers to a nucleic acid mimic, e.g., a DNA mimic, in which the deoxyribose phosphate backbone is replaced by a pseudopeptide backbone and only the four natural nucleobases are retained. The neutral backbone of a PNA can allow for specific hybridization to DNA and RNA under conditions of low ionic strength. The synthesis of PNA oligomers can be performed using standard solid phase peptide synthesis protocols as described in Hyrup et al. (1996) supra; Perry-O'Keefe et al. (1996) *Proc. Natl. Acad. Sci.* 93: 14670-675.

PNAs of 21910, 56634, 55053, 2504, 15977, 14760, 25501, 17903, 3700, 21529, 26176, 26343, 56638, 18610, 33217, 21967, h1983, m1983, 38555 or 593 nucleic acid molecules can be used in therapeutic and diagnostic applications. For example, PNAs can be used as antisense or antigene agents for sequence-specific modulation of gene expression by, for example, inducing transcription or translation arrest or inhibiting replication. PNAs of 21910, 56634, 55053, 2504, 15977, 14760, 25501, 17903, 3700, 21529, 26176, 26343, 56638, 18610, 33217, 21967, h1983, m1983, 38555 or 593 nucleic acid molecules can also be used in the analysis of single base pair mutations in a gene, (e.g., by PNA-directed PCR clamping); as 'artificial restriction enzymes' when used in combination with other enzymes, (e.g., S1 nucleases (Hyrup et al. (1996) supra)); or as probes or primers for DNA sequencing or hybridization (Hyrup et al. (1996) supra; Perry-O'Keefe supra).

In other embodiments, the oligonucleotide can include other appended groups such as peptides (e.g., for targeting host cell receptors in vivo), or agents facilitating transport across the cell membrane (see, e.g., Letsinger et al. (1989) *Proc. Natl. Acad. Sci. USA* 86:6553-6556; Lemaitre et al. (1987) *Proc. Natl. Acad. Sci. USA* 84:648-652; PCT Publication No. WO88/09810) or the blood-brain barrier (see, e.g., PCT Publication No. WO89/10134). In addition, oligonucleotides can be modified with hybridization-triggered cleavage agents (see, e.g., Krol et al. (1988) *Bio-Techniques* 6:958-976) or intercalating agents. (see, e.g., Zon (1988) *Pharm. Res.* 5:539-549). To this end, the oligonucleotide can be conjugated to another molecule, (e.g., a peptide, hybridization triggered cross-linking agent, transport agent, or hybridization-triggered cleavage agent).

The invention also includes molecular beacon oligonucleotide primer and probe molecules having at least one region which is complementary to a 21910, 56634, 55053, 2504, 15977, 14760, 25501, 17903, 3700, 21529, 26176, 26343, 56638, 18610, 33217, 21967, h1983, m1983, 38555 or 593 nucleic acid of the invention, two complementary regions one having a fluorophore and one a quencher such that the molecular beacon is useful for quantitating the presence of the 21910, 56634, 55053, 2504, 15977, 14760, 25501, 17903, 3700, 21529, 26176, 26343, 56638, 18610, 33217, 21967, h1983, m1983, 38555 or 593 nucleic acid of the invention in a sample. Molecular beacon nucleic acids are described, for example, in Lizardi et al., U.S. Pat. No. 5,854,033; Nazarenko et al., U.S. Pat. No. 5,866,336, and Livak et al., U.S. Pat. No. 5,876,930.

Isolated 21910, 56634, 55053, 2504, 15977, 14760, 25501, 17903, 3700, 21529, 26176, 26343, 56638, 18610, 33217, 21967, h1983, m1983, 38555 or 593 Polypeptides In another aspect, the invention features, an isolated 21910, 56634, 55053, 2504, 15977, 14760, 25501, 17903, 3700, 21529, 26176, 26343, 56638, 18610, 33217, 21967, h1983, m1983, 38555 or 593 protein, or fragment, e.g., a biologically active portion, for use as immunogens or antigens to raise or test (or more generally to bind) anti-21910, 56634, 55053, 2504, 15977, 14760, 25501, 17903, 3700, 21529, 26176, 26343, 56638, 18610, 33217, 21967, h1983, m1983, 38555 or 593 antibodies. 21910, 56634, 55053, 2504, 15977, 14760, 25501, 17903, 3700, 21529, 26176, 26343, 56638, 18610, 33217, 21967, h1983, m1983, 38555 or 593 protein can be isolated from cells or tissue sources using standard protein purification techniques. 21910, 56634, 55053, 2504, 15977, 14760, 25501, 17903, 3700, 21529, 26176, 26343, 56638, 18610, 33217, 21967, h1983, m1983, 38555 or 593 protein or fragments thereof can be produced by recombinant DNA techniques or synthesized chemically.

Polypeptides of the invention include those which arise as a result of the existence of multiple genes, alternative transcription events, alternative RNA splicing events, and alternative translational and post-translational events. The polypeptide can be expressed in systems, e.g., cultured cells, which result in substantially the same post-translational modifications present when the polypeptide is expressed in a native cell, or in systems which result in the alteration or omission of post-translational modifications, e.g., glycosylation or cleavage, present in a native cell.

In a preferred embodiment, a 21910, 56634, 55053, 2504, 15977, 14760, 25501, 17903, 3700, 21529, 26176, 26343, 56638, 18610, 33217, 21967, h1983, m1983, 38555 or 593 polypeptide has one or more of the following characteristics: it has the ability: (1) modulate ATP-dependent phosphorylation of GMP, dGMP, or cGMP; (2) catalyze the formation of phosphoinositol-4,5-bisphosphate via the phosphorylation of phosphatidylinositol-4-phosphate; (3) mediate the phosphoinositide signaling cascade; (4) convert a substrate or target molecule to a product (e.g., transfer of a phosphate group to a substrate or target molecule, or conversion of ATP to ADP); (5) interact with and/or phosphate transfer to a second protein; (6) modulate intra- or intercellular signaling and/or gene transcription (e.g., either directly or indirectly); (7) modulate the phosphorylation state of target molecules (e.g., a kinase or a phosphatase molecule) or the phosphorylation state of one or more proteins involved in cellular growth, metabolism, or differentiation, e.g., cardiac, epithelial, or neuronal cell growth or differentiation; (8) convert a substrate or target molecule to a product (e.g., transfer of a methyl group to or from the substrate or target molecule); (9) interact with and/or methyl transfer to a second target molecule e.g., a nucleic acid molecule (e.g., DNA or RNA), a small organic molecule (e.g., a hormone, neurotransmitter or a coenzyme) or a protein; 10) cleave a protein precursor to maturation; (11) catalyze protein degradation; (12) catalyze the formation of a covalent bond within or between an amino acid residue (e.g., a serine or threonine residue) and a phosphate moiety; (13) modulate the cAMP signal transduction pathway; (14) modulate a target cell's cAMP concentration; (15) modulate cAMP-dependent protein kinase activity, such as protein kinase A; (16) modulate a calpain protease response; (17) modulate metabolism and catabolism of biochemical molecules, e.g., molecules necessary for energy production or storage; (18) modulate betaine synthesis from choline; (19) modulate methionine synthesis from homocysteine; (20) modulate the activity of a bioactive peptide, (21) cleave a neprilysin substrate, e.g., enkephalin; (22) modulate membrane excitability, (23) influence the resting potential of membranes; (24) modulate acetyl-CoA ligase activity; (25) promote activation of acetate; (26) promote acetate utilization; (27) enhance uptake of acetate into fatty acids and biochemical products made from fatty acids (e.g., lipids and hormones such as sterol hormones); (28) crosslink an extracellular matrix component; (29) regulate bone resorption and/or metabolism; (30) regulate copper metabolism; (31) it has a molecular weight, e.g., a deduced molecular weight, preferably ignoring any contribution of post translational modifications, amino acid composition or other physical characteristic of a 21910, 56634, 55053, 2504, 15977, 14760, 25501, 17903, 3700, 21529, 26176, 26343, 56638, 18610, 33217, 21967, h1983, m1983, 38555 or 593 polypeptide, e.g., a polypeptide of SEQ ID NO:2, 6, 11, 19, 22, 25, 32, 40, 44, 47, 50, 55, 58, 64, 67, 72, 89, 105, 108 or 112; (32) it has an overall sequence similarity of at least 60%, preferably at least 70%, more preferably at least 80, 90, or 95%, with a polypeptide of SEQ ID NO:2, 6, 11, 19, 22, 25, 32, 40, 44, 47, 50, 55, 58, 64, 67, 72, 89, 105, 108 or 112; (33) it is expressed in a multitude of human tissues and cell lines (refer to section for each molecule of the invention); and (34) it has specific domains which are preferably about 70%, 80%, 90% or 95% identical to the identified amino acid residues of SEQ ID NO:2, 6, 11, 19, 22, 25, 32, 40, 44, 47, 50, 55, 58, 64, 67, 72, 89, 105, 108 or 112 (refer to section for each molecule of the invention for domain names and locations within amino acid sequence).

In a preferred embodiment the 21910, 56634, 55053, 2504, 15977, 14760, 25501, 17903, 3700, 21529, 26176, 26343, 56638, 18610, 33217, 21967, h1983, m1983, 38555 or 593 protein, or fragment thereof, differs from the corresponding sequence in SEQ ID NO:2, 6, 11, 19, 22, 25, 32, 40, 44, 47, 50, 55, 58, 64, 67, 72, 89, 105, 108 or 112. In one embodiment it differs by at least one but by less than 15, 10 or 5 amino acid residues. In another it differs from the corresponding sequence in SEQ ID NO:2, 6, 11, 19, 22, 25, 32, 40, 44, 47, 50, 55, 58, 64, 67, 72, 89, 105, 108 or 112 by at least one residue but less than 20%, 15%, 10% or 5% of the residues in it differ from the corresponding sequence in SEQ ID NO:2, 6, 11, 19, 22, 25, 32, 40, 44, 47, 50, 55, 58, 64, 67, 72, 89, 105, 108 or 112. (If this comparison requires alignment the sequences should be aligned for maximum homology. "Looped" out sequences from deletions or insertions, or mismatches, are considered differences.) The differences are, preferably, differences or changes at a non-essential residue or a conservative substitution. In a preferred embodiment the differences are not in the identified or conserved domain(s) within SEQ ID NO:2, 6, 11, 19, 22, 25, 32, 40, 44, 47, 50, 55, 58, 64, 67, 72, 89, 105, 108 or 112. In another embodiment one or more differences are in the cidentified or conserved domain(s) within SEQ ID NO:2, 6, 11, 19, 22, 25, 32, 40, 44, 47, 50, 55, 58, 64, 67, 72, 89, 105, 108 or 112.

Other embodiments include a protein that contains one or more changes in amino acid sequence, e.g., a change in an amino acid residue which is not essential for activity. Such 21910, 56634, 55053, 2504, 15977, 14760, 25501, 17903, 3700, 21529, 26176, 26343, 56638, 18610, 33217, 21967, h1983, m1983, 38555 or 593 proteins differ in amino acid sequence from SEQ ID NO:2, 6, 11, 19, 22, 25, 32, 40, 44, 47, 50, 55, 58, 64, 67, 72, 89, 105, 108 or 112, yet retain biological activity.

In one embodiment, the protein includes an amino acid sequence at least about 60%, 65%, 70%, 75%, 80%, 85%, 90%, 95%, 98% or more homologous to SEQ ID NO:2, 6, 11, 19, 22, 25, 32, 40, 44, 47, 50, 55, 58, 64, 67, 72, 89, 105, 108 or 112.

A 21910, 56634, 55053, 2504, 15977, 14760, 25501, 17903, 3700, 21529, 26176, 26343, 56638, 18610, 33217, 21967, h1983, m1983, 38555 or 593 protein or fragment is provided which varies from the sequence of SEQ ID NO:2, 6, 11, 19, 22, 25, 32, 40, 44, 47, 50, 55, 58, 64, 67, 72, 89, 105, 108 or 112 in regions defined by amino acids that are not within identified or conserved domains or regions by at least one but by less than 15, 10 or 5 amino acid residues in the protein or fragment but which does not differ from SEQ ID NO:2, 6, 11, 19, 22, 25, 32, 40, 44, 47, 50, 55, 58, 64, 67, 72, 89, 105, 108 or 112 in regions defined by amino acids that are within identified or conserved domains or regions. (If this comparison requires alignment the sequences should be aligned for maximum homology. "Looped" out sequences from deletions or insertions, or mismatches, are considered differences.) In some embodiments the difference is at a non-essential residue or is a conservative substitution, while in others the difference is at an essential residue or is a non-conservative substitution.

In one embodiment, a biologically active portion of a 21910, 56634, 55053, 2504, 15977, 14760, 25501, 17903, 3700, 21529, 26176, 26343, 56638, 18610, 33217, 21967, h1983, m1983, 38555 or 593 protein includes an identified domain (refer to section for each molecule of the invention). Moreover, other biologically active portions, in which other regions of the protein are deleted, can be prepared by recombinant techniques and evaluated for one or more of the functional activities of a native 21910, 56634, 55053, 2504, 15977, 14760, 25501, 17903, 3700, 21529, 26176, 26343, 56638, 18610, 33217, 21967, h1983, m1983, 38555 or 593 protein.

In a preferred embodiment, the 21910, 56634, 55053, 2504, 15977, 14760, 25501, 17903, 3700, 21529, 26176, 26343, 56638, 18610, 33217, 21967, h1983, m1983, 38555 or 593 protein has an amino acid sequence shown in SEQ ID NO:2, 6, 11, 19, 22, 25, 32, 40, 44, 47, 50, 55, 58, 64, 67, 72, 89, 105, 108 or 112. In other embodiments, the 21910, 56634, 55053, 2504, 15977, 14760, 25501, 17903, 3700, 21529, 26176, 26343, 56638, 18610, 33217, 21967, h1983, m1983, 38555 or 593 protein is sufficiently or substantially identical to SEQ ID NO:2, 6, 11, 19, 22, 25, 32, 40, 44, 47, 50, 55, 58, 64, 67, 72, 89, 105, 108 or 112. In yet another embodiment, the 21910, 56634, 55053, 2504, 15977, 14760, 25501, 17903, 3700, 21529, 26176, 26343, 56638, 18610, 33217, 21967, h1983, m1983, 38555 or 593 protein is sufficiently or substantially identical to SEQ ID NO:2, 6, 11, 19, 22, 25, 32, 40, 44, 47, 50, 55, 58, 64, 67, 72, 89, 105, 108 or 112 and retains the functional activity of the protein of SEQ ID NO:2, 6, 11, 19, 22, 25, 32, 40, 44, 47, 50, 55, 58, 64, 67, 72, 89, 105, 108 or 112, as described in detail in the subsections above.

21910, 56634, 55053, 2504, 15977, 14760, 25501, 17903, 3700, 21529, 26176, 26343, 56638, 18610, 33217, 21967, h1983, m1983, 38555 or 593 Chimeric or Fusion Proteins In another aspect, the invention provides 21910, 56634, 55053, 2504, 15977, 14760, 25501, 17903, 3700, 21529, 26176, 26343, 56638, 18610, 33217, 21967, h1983, m1983, 38555 or 593 chimeric or fusion proteins. As used herein, a 21910, 56634, 55053, 2504, 15977, 14760, 25501, 17903, 3700, 21529, 26176, 26343, 56638, 18610, 33217, 21967, h1983, m1983, 38555 or 593 "chimeric protein" or "fusion protein" includes a 21910, 56634, 55053, 2504, 15977, 14760, 25501, 17903, 3700, 21529, 26176, 26343, 56638, 18610, 33217, 21967, h1983, m1983, 38555 or 593 polypeptide linked to a non-21910, 56634, 55053, 2504, 15977, 14760, 25501, 17903, 3700, 21529, 26176, 26343, 56638, 18610, 33217, 21967, h1983, m1983, 38555 or 593 polypeptide. A "non-21910, 56634, 55053, 2504, 15977, 14760, 25501, 17903, 3700, 21529, 26176, 26343, 56638, 18610, 33217, 21967, h1983, m1983, 38555 or 593 polypeptide" refers to a polypeptide having an amino acid sequence corresponding to a protein which is not substantially homologous to the 21910, 56634, 55053, 2504, 15977, 14760, 25501, 17903, 3700, 21529, 26176, 26343, 56638, 18610, 33217, 21967, h1983, m1983, 38555 or 593 protein, e.g., a protein which is different from the 21910, 56634, 55053, 2504, 15977, 14760, 25501, 17903, 3700, 21529, 26176, 26343, 56638, 18610, 33217, 21967, h1983, m1983, 38555 or 593 protein and which is derived from the same or a different organism. The 21910, 56634, 55053, 2504, 15977, 14760, 25501, 17903, 3700, 21529, 26176, 26343, 56638, 18610, 33217, 21967, h1983, m1983, 38555 or 593 polypeptide of the fusion protein can correspond to all or a portion e.g., a fragment described herein of a 21910, 56634, 55053, 2504, 15977, 14760, 25501, 17903, 3700, 21529, 26176, 26343, 56638, 18610, 33217, 21967, h1983, m1983, 38555 or 593 amino acid sequence. In a preferred embodiment, a 21910, 56634, 55053, 2504, 15977, 14760, 25501, 17903, 3700, 21529, 26176, 26343, 56638, 18610, 33217, 21967, h1983, m1983, 38555 or 593 fusion protein includes at least one (or two) biologically active portion of a 21910, 56634, 55053, 2504, 15977, 14760, 25501, 17903, 3700, 21529, 26176, 26343, 56638, 18610, 33217, 21967, h1983, m1983, 38555 or 593 protein. The non-21910, 56634, 55053, 2504, 15977, 14760, 25501, 17903, 3700, 21529, 26176, 26343, 56638, 18610, 33217, 21967, h1983, m1983, 38555 or 593 polypeptide can be fused to the N-terminus or C-terminus of the 21910, 56634, 55053, 2504, 15977, 14760, 25501, 17903, 3700, 21529, 26176, 26343, 56638, 18610, 33217, 21967, h1983, m1983, 38555 or 593 polypeptide.

The fusion protein can include a moiety which has a high affinity for a ligand. For example, the fusion protein can be a GST-21910, 56634, 55053, 2504, 15977, 14760, 25501, 17903, 3700, 21529, 26176, 26343, 56638, 18610, 33217, 21967, h1983, m1983, 38555 or 593 fusion protein in which the 21910, 56634, 55053, 2504, 15977, 14760, 25501, 17903, 3700, 21529, 26176, 26343, 56638, 18610, 33217, 21967, h1983, m1983, 38555 or 593 sequences are fused to the C-terminus of the GST sequences. Such fusion proteins can facilitate the purification of recombinant 21910, 56634, 55053, 2504, 15977, 14760, 25501, 17903, 3700, 21529, 26176, 26343, 56638, 18610, 33217, 21967, h1983, m1983, 38555 or 593. Alternatively, the fusion protein can be a 21910, 56634, 55053, 2504, 15977, 14760, 25501, 17903, 3700, 21529, 26176, 26343, 56638, 18610, 33217, 21967, h1983, m1983, 38555 or 593 protein containing a heterologous signal sequence at its N-terminus. In certain host cells (e.g., mammalian host cells), expression and/or secretion of 21910, 56634, 55053, 2504, 15977, 14760, 25501, 17903, 3700, 21529, 26176, 26343, 56638, 18610, 33217, 21967, h1983, m1983, 38555 or 593 can be increased through use of a heterologous signal sequence.

Fusion proteins can include all or a part of a serum protein, e.g., a portion of an immunoglobulin (e.g., IgG, IgA, or IgE), e.g., an Fc region and/or the hinge C1 and C2 sequences of an immunoglobulin or human serum albumin.

The 21910, 56634, 55053, 2504, 15977, 14760, 25501, 17903, 3700, 21529, 26176, 26343, 56638, 18610, 33217, 21967, h1983, m1983, 38555 or 593 fusion proteins of the invention can be incorporated into pharmaceutical compositions and administered to a subject in vivo. The 21910, 56634, 55053, 2504, 15977, 14760, 25501, 17903, 3700, 21529, 26176, 26343, 56638, 18610, 33217, 21967, h1983, m1983, 38555 or 593 fusion proteins can be used to affect the bioavailability of a 21910, 56634, 55053, 2504, 15977, 14760, 25501, 17903, 3700, 21529, 26176, 26343, 56638, 18610, 33217, 21967, h1983, m1983, 38555 or 593 substrate. 21910, 56634, 55053, 2504, 15977, 14760, 25501, 17903, 3700, 21529, 26176, 26343, 56638, 18610, 33217, 21967, h1983, m1983, 38555 or 593 fusion proteins can be useful therapeutically for the treatment of disorders caused by, for example, (i) aberrant modification or mutation of a gene encoding a 21910, 56634, 55053, 2504, 15977, 14760, 25501, 17903, 3700, 21529, 26176, 26343, 56638, 18610, 33217, 21967, h1983, m1983, 38555 or 593 protein; (ii) mis-regulation of the 21910, 56634, 55053, 2504, 15977, 14760, 25501, 17903, 3700, 21529, 26176, 26343, 56638, 18610, 33217, 21967, h1983, m1983, 38555 or 593 gene; and (iii) aberrant post-translational modification of a 21910, 56634, 55053, 2504, 15977, 14760, 25501, 17903, 3700, 21529, 26176, 26343, 56638, 18610, 33217, 21967, h1983, m1983, 38555 or 593 protein.

Moreover, the 21910, 56634, 55053, 2504, 15977, 14760, 25501, 17903, 3700, 21529, 26176, 26343, 56638, 18610, 33217, 21967, h1983, m1983, 38555 or 593-fusion proteins of the invention can be used as immunogens to produce anti-21910, 56634, 55053, 2504, 15977, 14760, 25501, 17903, 3700, 21529, 26176, 26343, 56638, 18610, 33217, 21967, h1983, m1983, 38555 or 593 antibodies in a subject, to purify 21910, 56634, 55053, 2504, 15977, 14760, 25501, 17903, 3700, 21529, 26176, 26343, 56638, 18610, 33217, 21967, h1983, m1983, 38555 or 593 ligands and in screening assays to identify molecules which inhibit the interaction of 21910, 56634, 55053, 2504, 15977, 14760, 25501, 17903, 3700, 21529, 26176, 26343, 56638, 18610, 33217, 21967, h1983, m1983, 38555 or 593 with a 21910, 56634, 55053, 2504, 15977, 14760, 25501, 17903, 3700, 21529, 26176, 26343, 56638, 18610, 33217, 21967, h1983, m1983, 38555 or 593 substrate.

Expression vectors are commercially available that already encode a fusion moiety (e.g., a GST polypeptide). A 21910, 56634, 55053, 2504, 15977, 14760, 25501, 17903, 3700, 21529, 26176, 26343, 56638, 18610, 33217, 21967, h1983, m1983, 38555 or 593-encoding nucleic acid can be cloned into such an expression vector such that the fusion moiety is linked in-frame to the 21910, 56634, 55053, 2504, 15977, 14760, 25501, 17903, 3700, 21529, 26176, 26343, 56638, 18610, 33217, 21967, h1983, m1983, 38555 or 593 protein.

Variants of 21910, 56634, 55053, 2504, 15977, 14760, 25501, 17903, 3700, 21529, 26176, 26343, 56638, 18610, 33217, 21967, h1983, m1983, 38555 or 593 Proteins In another aspect, the invention also features a variant of a 21910, 56634, 55053, 2504, 15977, 14760, 25501, 17903, 3700, 21529, 26176, 26343, 56638, 18610, 33217, 21967, h1983, m1983, 38555 or 593 polypeptide, e.g., which functions as an agonist (mimetics) or as an antagonist. Variants of the 21910, 56634, 55053, 2504, 15977, 14760, 25501, 17903, 3700, 21529, 26176, 26343, 56638, 18610, 33217, 21967, h1983, m1983, 38555 or 593 proteins can be generated by mutagenesis, e.g., discrete point mutation, the insertion or deletion of sequences or the truncation of a 21910, 56634, 55053, 2504, 15977, 14760, 25501, 17903, 3700, 21529, 26176, 26343, 56638, 18610, 33217, 21967, h1983, m1983, 38555 or 593 protein. An agonist of the 21910, 56634, 55053, 2504, 15977, 14760, 25501, 17903, 3700, 21529, 26176, 26343, 56638, 18610, 33217, 21967, h1983, m1983, 38555 or 593 proteins can retain substantially the same, or a subset, of the biological activities of the naturally occurring form of a 21910, 56634, 55053, 2504, 15977, 14760, 25501, 17903, 3700, 21529, 26176, 26343, 56638, 18610, 33217, 21967, h1983, m1983, 38555 or 593 protein. An antagonist of a 21910, 56634, 55053, 2504, 15977, 14760, 25501, 17903, 3700, 21529, 26176, 26343, 56638, 18610, 33217, 21967, h1983, m1983, 38555 or 593 protein can inhibit one or more of the activities of the naturally occurring form of the 21910, 56634, 55053, 2504, 15977, 14760, 25501, 17903, 3700, 21529, 26176, 26343, 56638, 18610, 33217, 21967, h1983, m1983, 38555 or 593 protein by, for example, competitively modulating a 21910, 56634, 55053, 2504, 15977, 14760, 25501, 17903, 3700, 21529, 26176, 26343, 56638, 18610, 33217, 21967, h1983, m1983, 38555 or 593-mediated activity of a 21910, 56634, 55053, 2504, 15977, 14760, 25501, 17903, 3700, 21529, 26176, 26343, 56638, 18610, 33217, 21967, h1983, m1983, 38555 or 593 protein. Thus, specific biological effects can be elicited by treatment with a variant of limited function. Preferably, treatment of a subject with a variant having a subset of the biological activities of the naturally occurring form of the protein has fewer side effects in a subject relative to treatment with the naturally occurring form of the 21910, 56634, 55053, 2504, 15977, 14760, 25501, 17903, 3700, 21529, 26176, 26343, 56638, 18610, 33217, 21967, h1983, m1983, 38555 or 593 protein.

Variants of a 21910, 56634, 55053, 2504, 15977, 14760, 25501, 17903, 3700, 21529, 26176, 26343, 56638, 18610, 33217, 21967, h1983, m1983, 38555 or 593 protein can be identified by screening combinatorial libraries of mutants, e.g., truncation mutants, of a 21910, 56634, 55053, 2504, 15977, 14760, 25501, 17903, 3700, 21529, 26176, 26343, 56638, 18610, 33217, 21967, h1983, m1983, 38555 or 593 protein for agonist or antagonist activity.

Libraries of fragments e.g., N terminal, C terminal, or internal fragments, of a 21910, 56634, 55053, 2504, 15977, 14760, 25501, 17903, 3700, 21529, 26176, 26343, 56638, 18610, 33217, 21967, h1983, m1983, 38555 or 593 protein coding sequence can be used to generate a variegated population of fragments for screening and subsequent selection of variants of a 21910, 56634, 55053, 2504, 15977, 14760, 25501, 17903, 3700, 21529, 26176, 26343, 56638, 18610, 33217, 21967, h1983, m1983, 38555 or 593 protein.

Variants in which a cysteine residues is added or deleted or in which a residue which is glycosylated is added or deleted are particularly preferred.

Methods for screening gene products of combinatorial libraries made by point mutations or truncation, and for screening cDNA libraries for gene products having a selected property are known in the art. Recursive ensemble mutagenesis (REM), a new technique which enhances the frequency of functional mutants in the libraries, can be used in combination with the screening assays to identify 21910, 56634, 55053, 2504, 15977, 14760, 25501, 17903, 3700, 21529, 26176, 26343, 56638, 18610, 33217, 21967, h1983, m1983, 38555 or 593 variants (Arkin and Yourvan (1992) *Proc. Natl. Acad. Sci. USA* 89:7811-7815; Delgrave et al. (1993) *Protein Engineering* 6:327-331). Cell based assays can be exploited to analyze a variegated 21910, 56634, 55053, 2504, 15977, 14760, 25501, 17903, 3700, 21529, 26176, 26343, 56638, 18610, 33217, 21967, h1983, m1983, 38555 or 593 library. For example, a library of expression vectors can be transfected into a cell line, e.g., a cell line, which ordinarily responds to 21910, 56634, 55053, 2504, 15977, 14760, 25501, 17903, 3700, 21529, 26176, 26343, 56638, 18610, 33217, 21967, h1983, m1983, 38555 or 593 in a substrate-dependent manner. The transfected cells are then contacted with 21910, 56634, 55053, 2504, 15977, 14760, 25501, 17903, 3700, 21529, 26176, 26343, 56638, 18610, 33217, 21967, h1983, m1983, 38555 or 593 and the effect of the expression of the mutant on signaling by the 21910, 56634, 55053, 2504, 15977, 14760, 25501, 17903, 3700, 21529, 26176, 26343, 56638, 18610, 33217, 21967, h1983, m1983, 38555 or 593 substrate can be detected, e.g., by measuring either guanylate kinase, phophatidylinositol 4-phosphate 5-kinase, kinase, transferase, aminopeptidase, adenylate cyclase, calpain protease, oxidoreductase, neprilysin protease, AMP binding enzyme and lysyl oxidase activity, or other activity. Plasmid DNA can then be recovered from the cells which score for inhibition, or alternatively, potentiation of signaling by the 21910, 56634, 55053, 2504, 15977, 14760, 25501, 17903, 3700, 21529, 26176, 26343, 56638, 18610, 33217, 21967, h1983, m1983, 38555 or 593 substrate, and the individual clones further characterized.

In another aspect, the invention features a method of making a 21910, 56634, 55053, 2504, 15977, 14760, 25501, 17903, 3700, 21529, 26176, 26343, 56638, 18610, 33217, 21967, h1983, m1983, 38555 or 593 polypeptide, e.g., a peptide having a non-wild type activity, e.g., an antagonist, agonist, or super agonist of a naturally occurring 21910, 56634, 55053, 2504, 15977, 14760, 25501, 17903, 3700, 21529, 26176, 26343, 56638, 18610, 33217, 21967, h1983, m1983, 38555 or 593 polypeptide, e.g., a naturally occurring 21910, 56634, 55053, 2504, 15977, 14760, 25501, 17903, 3700, 21529, 26176, 26343, 56638, 18610, 33217, 21967, h1983, m1983, 38555 or 593 polypeptide. The method includes altering the sequence of a 21910, 56634, 55053, 2504, 15977, 14760, 25501, 17903, 3700, 21529, 26176, 26343, 56638, 18610, 33217, 21967, h1983, m1983, 38555 or 593 polypeptide, e.g., altering the sequence, e.g., by substitution or deletion of one or more residues of a non-conserved region, a domain or residue disclosed herein, and testing the altered polypeptide for the desired activity.

In another aspect, the invention features a method of making a fragment or analog of a 21910, 56634, 55053, 2504, 15977, 14760, 25501, 17903, 3700, 21529, 26176, 26343, 56638, 18610, 33217, 21967, h1983, m1983, 38555 or 593 polypeptide a biological activity of a naturally occurring 21910, 56634, 55053, 2504, 15977, 14760, 25501, 17903, 3700, 21529, 26176, 26343, 56638, 18610, 33217, 21967, h1983, m1983, 38555 or 593 polypeptide. The method includes altering the sequence, e.g., by substitution or deletion of one or more residues, of a 21910, 56634, 55053, 2504, 15977, 14760, 25501, 17903, 3700, 21529, 26176, 26343, 56638, 18610, 33217, 21967, h1983, m1983, 38555 or 593 polypeptide, e.g., altering the sequence of a non-conserved region, or a domain or residue described herein, and testing the altered polypeptide for the desired activity.

Anti-21910, 56634, 55053, 2504, 15977, 14760, 25501, 17903, 3700, 21529, 26176, 26343, 56638, 18610, 33217, 21967, h1983, m1983, 38555 or 593 Antibodies In another aspect, the invention provides an anti-21910, 56634, 55053, 2504, 15977, 14760, 25501, 17903, 3700, 21529, 26176, 26343, 56638, 18610, 33217, 21967, h1983, m1983, 38555 or 593 antibody. The term "antibody" as used herein refers to an immunoglobulin molecule or immunologically active portion thereof, i.e., an antigen-binding portion.

Examples of immunologically active portions of immunoglobulin molecules include scFV and dcFV fragments, Fab and F(ab')$_2$ fragments which can be generated by treating the antibody with an enzyme such as papain or pepsin, respectively.

The antibody can be a polyclonal, monoclonal, recombinant, e.g., a chimeric or humanized, fully human, non-human, e.g., murine, or single chain antibody. In a preferred embodiment it has effector function and can fix complement. The antibody can be coupled to a toxin or imaging agent.

A full-length 21910, 56634, 55053, 2504, 15977, 14760, 25501, 17903, 3700, 21529, 26176, 26343, 56638, 18610, 33217, 21967, h1983, m1983, 38555 or 593 protein or, antigenic peptide fragment of 21910, 56634, 55053, 2504, 15977, 14760, 25501, 17903, 3700, 21529, 26176, 26343, 56638, 18610, 33217, 21967, h1983, m1983, 38555 or 593 can be used as an immunogen or can be used to identify anti-21910, 56634, 55053, 2504, 15977, 14760, 25501, 17903, 3700, 21529, 26176, 26343, 56638, 18610, 33217, 21967, h1983, m1983, 38555 or 593 antibodies made with other immunogens, e.g., cells, membrane preparations, and the like. The antigenic peptide of 21910, 56634, 55053, 2504, 15977, 14760, 25501, 17903, 3700, 21529, 26176, 26343, 56638, 18610, 33217, 21967, h1983, m1983, 38555 or 593 should include at least 8 amino acid residues of the amino acid sequence shown in SEQ ID NO:2, 6, 11, 19, 22, 25, 32, 40, 44, 47, 50, 55, 58, 64, 67, 72, 89, 105, 108 or 112 and encompasses an epitope of 21910, 56634, 55053, 2504, 15977, 14760, 25501, 17903, 3700, 21529, 26176, 26343, 56638, 18610, 33217, 21967, h1983, m1983, 38555 or 593. Preferably, the antigenic peptide includes at least 10 amino acid residues, more preferably at least 15 amino acid residues, even more preferably at least 20 amino acid residues, and most preferably at least 30 amino acid residues.

Fragments of 21910, 56634, 55053, 2504, 15977, 14760, 25501, 17903, 3700, 21529, 26176, 26343, 56638, 18610, 33217, 21967, h1983, m1983, 38555 or 593 which include hydrophilic regions of SEQ ID NO:2, 6, 11, 19, 22, 25, 32, 40, 44, 47, 50, 55, 58, 64, 67, 72, 89, 105, 108 or 112 can be used to make, e.g., used as immunogens or used to characterize the specificity of an antibody, antibodies against hydrophilic regions of the 21910, 56634, 55053, 2504, 15977, 14760, 25501, 17903, 3700, 21529, 26176, 26343, 56638, 18610, 33217, 21967, h1983, m1983, 38555 or 593 protein. Similarly, fragments of 21910, 56634, 55053, 2504, 15977, 14760, 25501, 17903, 3700, 21529, 26176, 26343, 56638, 18610, 33217, 21967, h1983, m1983, 38555 or 593 which include hydrophobic regions of SEQ ID NO:2, 6, 11, 19, 22, 25, 32, 40, 44, 47, 50, 55, 58, 64, 67, 72, 89, 105, 108 or 112 can be used to make an antibody against a hydrophobic region of the 21910, 56634, 55053, 2504, 15977, 14760, 25501, 17903, 3700, 21529, 26176, 26343, 56638, 18610, 33217, 21967, h1983, m1983, 38555 or 593 protein; fragments of 21910, 56634, 55053, 2504, 15977, 14760, 25501, 17903, 3700, 21529, 26176, 26343, 56638, 18610, 33217, 21967, h1983, m1983, 38555 or 593 which include residues within extra cellular domain(s) of SEQ ID NO:2, 6, 11, 19, 22, 25, 32, 40, 44, 47, 50, 55, 58, 64, 67, 72, 89, 105, 108 or 112 can be used to make an antibody against an extracellular or non-cytoplasmic region of the 21910, 56634, 55053, 2504, 15977, 14760, 25501, 17903, 3700, 21529, 26176, 26343, 56638, 18610, 33217, 21967, h1983, m1983, 38555 or 593 protein; fragments of 21910, 56634, 55053, 2504, 15977, 14760, 25501, 17903, 3700, 21529, 26176, 26343, 56638, 18610, 33217, 21967, h1983, m1983, 38555 or 593 which include residues within intracellular regions of SEQ ID NO:2, 6, 11, 19, 22, 25, 32, 40, 44, 47, 50, 55, 58, 64, 67, 72, 89, 105, 108 or 112 can be used to make an antibody against an intracellular region of the 21910, 56634, 55053, 2504, 15977, 14760, 25501, 17903, 3700, 21529, 26176, 26343, 56638, 18610, 33217, 21967, h1983, m1983, 38555 or 593 protein; a fragment of 21910, 56634, 55053, 2504, 15977, 14760, 25501, 17903, 3700, 21529, 26176, 26343, 56638, 18610, 33217, 21967, h1983, m1983, 38555 or 593 which include residues within identified or conserved domains of SEQ ID NO:2, 6, 11, 19, 22, 25, 32, 40, 44, 47, 50, 55, 58, 64, 67, 72, 89, 105, 108 or 112 can be used to make an antibody against the identified or conserved domain of the 21910, 56634, 55053, 2504, 15977, 14760, 25501, 17903, 3700, 21529, 26176, 26343, 56638, 18610, 33217, 21967, h1983, m1983, 38555 or 593 protein.

Antibodies reactive with, or specific or selective for, any of these regions, or other regions or domains described herein are provided.

Preferred epitopes encompassed by the antigenic peptide are regions of 21910, 56634, 55053, 2504, 15977, 14760, 25501, 17903, 3700, 21529, 26176, 26343, 56638, 18610, 33217, 21967, h1983, m1983, 38555 or 593 located on the surface of the protein, e.g., hydrophilic regions, as well as regions with high antigenicity. For example, an Emini surface probability analysis of the human 21910, 56634, 55053, 2504, 15977, 14760, 25501, 17903, 3700, 21529, 26176, 26343, 56638, 18610, 33217, 21967, h1983, m1983, 38555 or 593 protein sequence can be used to indicate the regions that have a particularly high probability of being localized to the surface of the 21910, 56634, 55053, 2504, 15977, 14760, 25501, 17903, 3700, 21529, 26176, 26343, 56638, 18610, 33217, 21967, h1983, m1983, 38555 or 593 protein and are thus likely to constitute surface residues useful for targeting antibody production.

In a preferred embodiment the antibody can bind to the extracellular portion of the 21910, 56634, 55053, 2504, 15977, 14760, 25501, 17903, 3700, 21529, 26176, 26343, 56638, 18610, 33217, 21967, h1983, m1983, 38555 or 593 protein, e.g., it can bind to a whole cell which expresses the 21910, 56634, 55053, 2504, 15977, 14760, 25501, 17903, 3700, 21529, 26176, 26343, 56638, 18610, 33217, 21967, h1983, m1983, 38555 or 593 protein. In another embodiment, the antibody binds an intracellular portion of the 21910, 56634, 55053, 2504, 15977, 14760, 25501, 17903, 3700, 21529, 26176, 26343, 56638, 18610, 33217, 21967, h1983, m1983, 38555 or 593 protein.

In a preferred embodiment the antibody binds an epitope on any domain or region on 21910, 56634, 55053, 2504, 15977, 14760, 25501, 17903, 3700, 21529, 26176, 26343, 56638, 18610, 33217, 21967, h1983, m1983, 38555 or 593 proteins described herein.

Additionally, chimeric, humanized, and completely human antibodies are also within the scope of the invention. Chimeric, humanized, but most preferably, completely human antibodies are desirable for applications which include repeated administration, e.g., therapeutic treatment of human patients, and some diagnostic applications.

Chimeric and humanized monoclonal antibodies, comprising both human and non-human portions, can be made using standard recombinant DNA techniques. Such chimeric and humanized monoclonal antibodies can be produced by recombinant DNA techniques known in the art, for example using methods described in Robinson et al. International Application No. PCT/US86/02269; Akira, et al. European Patent Application 184,187; Taniguchi, European Patent Application 171,496; Morrison et al. European Patent Application 173,494; Neuberger et al. PCT International Publication No. WO 86/01533; Cabilly et al. U.S. Pat. No. 4,816,567;

Cabilly et al. European Patent Application 125,023; Better et al. (1988) *Science* 240:1041-1043; Liu et al. (1987) *Proc. Natl. Acad. Sci. USA* 84:3439-3443; Liu et al. (1987) *J. Immunol.* 139:3521-3526; Sun et al. (1987) *Proc. Natl. Acad. Sci. USA* 84:214-218; Nishimura et al. (1987) *Canc. Res.* 47:999-1005; Wood et al. (1985) *Nature* 314:446-449; and Shaw et al. (1988) *J. Natl. Cancer Inst.* 80:1553-1559).

A humanized or complementarity determining region (CDR)-grafted antibody will have at least one or two, but generally all three recipient CDR's (of heavy and or light immunoglobulin chains) replaced with a donor CDR. The antibody may be replaced with at least a portion of a non-human CDR or only some of the CDR's may be replaced with non-human CDR's. It is only necessary to replace the number of CDR's required for binding of the humanized antibody to a 21910, 56634, 55053, 2504, 15977, 14760, 25501, 17903, 3700, 21529, 26176, 26343, 56638, 18610, 33217, 21967, h1983, m1983, 38555 or 593 or a fragment thereof. Preferably, the donor will be a rodent antibody, e.g., a rat or mouse antibody, and the recipient will be a human framework or a human consensus framework. Typically, the immunoglobulin providing the CDR's is called the "donor" and the immunoglobulin providing the framework is called the "acceptor." In one embodiment, the donor immunoglobulin is a non-human (e.g., rodent). The acceptor framework is a naturally-occurring (e.g., a human) framework or a consensus framework, or a sequence about 85% or higher, preferably 90%, 95%, 99% or higher identical thereto.

As used herein, the term "consensus sequence" refers to the sequence formed from the most frequently occurring amino acids (or nucleotides) in a family of related sequences (See e.g., Winnaker, (1987) *From Genes to Clones* (Verlagsgesellschaft, Weinheim, Germany). In a family of proteins, each position in the consensus sequence is occupied by the amino acid occurring most frequently at that position in the family. If two amino acids occur equally frequently, either can be included in the consensus sequence. A "consensus framework" refers to the framework region in the consensus immunoglobulin sequence.

An antibody can be humanized by methods known in the art. Humanized antibodies can be generated by replacing sequences of the Fv variable region which are not directly involved in antigen binding with equivalent sequences from human Fv variable regions. General methods for generating humanized antibodies are provided by Morrison (1985) *Science* 229:1202-1207, by Oi et al. (1986) *BioTechniques* 4:214, and by Queen et al. U.S. Pat. Nos. 5,585,089, 5,693,761 and 5,693,762, the contents of all of which are hereby incorporated by reference. Those methods include isolating, manipulating, and expressing the nucleic acid sequences that encode all or part of immunoglobulin Fv variable regions from at least one of a heavy or light chain. Sources of such nucleic acid are well known to those skilled in the art and, for example, may be obtained from a hybridoma producing an antibody against a 21910, 56634, 55053, 2504, 15977, 14760, 25501, 17903, 3700, 21529, 26176, 26343, 56638, 18610, 33217, 21967, h1983, m1983, 38555 or 593 polypeptide or fragment thereof. The recombinant DNA encoding the humanized antibody, or fragment thereof, can then be cloned into an appropriate expression vector.

Humanized or CDR-grafted antibodies can be produced by CDR-grafting or CDR substitution, wherein one, two, or all CDR's of an immunoglobulin chain can be replaced. See e.g., U.S. Pat. No. 5,225,539; Jones et al. (1986) *Nature* 321:552-525; Verhoeyan et al. (1988) *Science* 239:1534; Beidler et al. (1988) *J. Immunol.* 141:4053-4060; Winter U.S. Pat. No. 5,225,539, the contents of all of which are hereby expressly incorporated by reference. Winter describes a CDR-grafting method which may be used to prepare the humanized antibodies of the present invention (UK Patent Application GB 2188638A, filed on Mar. 26, 1987; Winter U.S. Pat. No. 5,225,539), the contents of which is expressly incorporated by reference.

Also within the scope of the invention are humanized antibodies in which specific amino acids have been substituted, deleted or added. Preferred humanized antibodies have amino acid substitutions in the framework region, such as to improve binding to the antigen. For example, a humanized antibody will have framework residues identical to the donor framework residue or to another amino acid other than the recipient framework residue. To generate such antibodies, a selected, small number of acceptor framework residues of the humanized immunoglobulin chain can be replaced by the corresponding donor amino acids. Preferred locations of the substitutions include amino acid residues adjacent to the CDR, or which are capable of interacting with a CDR (see e.g., U.S. Pat. No. 5,585,089). Criteria for selecting amino acids from the donor are described in U.S. Pat. No. 5,585,089, e.g., columns 12-16 of U.S. Pat. No. 5,585,089, the e.g., columns 12-16 of U.S. Pat. No. 5,585,089, the contents of which are hereby incorporated by reference. Other techniques for humanizing antibodies are described in Padlan et al. EP 519596 A1, published on Dec. 23, 1992.

Completely human antibodies are particularly desirable for therapeutic treatment of human patients. Such antibodies can be produced using transgenic mice that are incapable of expressing endogenous immunoglobulin heavy and light chains genes, but which can express human heavy and light chain genes. See, for example, Lonberg and Huszar (1995) *Int. Rev. Immunol.* 13:65-93); and U.S. Pat. Nos. 5,625,126; 5,633,425; 5,569,825; 5,661,016; and 5,545,806. In addition, companies such as Abgenix, Inc. (Fremont, Calif.) and Medarex, Inc. (Princeton, N.J.), can be engaged to provide human antibodies directed against a selected antigen using technology similar to that described above.

Completely human antibodies that recognize a selected epitope can be generated using a technique referred to as "guided selection." In this approach a selected non-human monoclonal antibody, e.g., a murine antibody, is used to guide the selection of a completely human antibody recognizing the same epitope. This technology is described by Jespers et al. (1994) *Bio/Technology* 12:899-903).

The anti-21910, 56634, 55053, 2504, 15977, 14760, 25501, 17903, 3700, 21529, 26176, 26343, 56638, 18610, 33217, 21967, h1983, m1983, 38555 or 593 antibody can be a single chain antibody. A single-chain antibody (scFV) can be engineered as described in, for example, Colcher et al. (1999) *Ann. NY Acad. Sci.* 880:263-80; and Reiter (1996) *Clin. Cancer Res.* 2:245-52. The single chain antibody can be dimerized or multimerized to generate multivalent antibodies having specificities for different epitopes of the same target 21910, 56634, 55053, 2504, 15977, 14760, 25501, 17903, 3700, 21529, 26176, 26343, 56638, 18610, 33217, 21967, h1983, m1983, 38555 or 593 protein.

In a preferred embodiment, the antibody has reduced or no ability to bind an Fc receptor. For example, it is an isotype or subtype, fragment or other mutant, which does not support binding to an Fc receptor, e.g., it has a mutagenized or deleted Fc receptor binding region.

An antibody (or fragment thereof) may be conjugated to a therapeutic moiety such as a cytotoxin, a therapeutic agent or a radioactive ion. A cytotoxin or cytotoxic agent includes any agent that is detrimental to cells. Examples include taxol, cytochalasin B, gramicidin D, ethidium bromide, emetine, mitomycin, etoposide, tenoposide, vincristine, vinblastine, colchicin, doxorubicin, daunorubicin, dihydroxy anthracin dione, mitoxantrone, mithramycin, actinomycin D, 1-dehydrotestosterone, glucocorticoids, procaine, tetracaine, lidocaine, propranolol, puromycin, maytansinoids, e.g., maytansinol (see U.S. Pat. No. 5,208,020), CC-1065 (see U.S. Pat. Nos. 5,475,092, 5,585,499, 5,846,545) and analogs or homologs thereof. Therapeutic agents include, but are not limited to, antimetabolites (e.g., methotrexate, 6-mercaptopurine, 6-thioguanine, cytarabine, 5-fluorouracil decarbazine), alkylating agents (e.g., mechlorethamine, thioepa chlorambucil, CC-1065, melphalan, carmustine (BSNU) and lomustine (CCNU), cyclothosphamide, busulfan, dibromomannitol, streptozotocin, mitomycin C, and cis-dichlorodiamine platinum (II) (DDP) cisplatin), anthracyclines (e.g., daunorubicin (formerly daunomycin) and doxorubicin), antibiotics (e.g., dactinomycin (formerly actinomycin), bleomycin, mithramycin, and anthramycin (AMC)), and anti-mitotic agents (e.g., vincristine, vinblastine, taxol and maytansinoids).

Radioactive ions include, but are not limited to iodine, yttrium, lutecium and praseodymium.

The conjugates of the invention can be used for modifying a given biological response, the therapeutic moiety is not to be construed as limited to classical chemical therapeutic agents. For example, the therapeutic moiety may be a protein or polypeptide possessing a desired biological activity. Such proteins may include, for example, a toxin such as abrin, ricin A, pseudomonas exotoxin, or diphtheria toxin; a protein such as tumor necrosis factor, α-interferon, β-interferon, nerve growth factor, platelet derived growth factor, tissue plasminogen activator; or, biological response modifiers such as, for example, lymphokines, interleukin-1 ("IL-1"), interleukin-2 ("IL-2"), interleukin-6 ("IL-6"), granulocyte macrophase colony stimulating factor ("GM-CSF"), granulocyte colony stimulating factor ("G-CSF"), or other growth factors.

Alternatively, an antibody can be conjugated to a second antibody to form an antibody heteroconjugate as described by Segal in U.S. Pat. No. 4,676,980.

An anti-21910, 56634, 55053, 2504, 15977, 14760, 25501, 17903, 3700, 21529, 26176, 26343, 56638, 18610, 33217, 21967, h1983, m1983, 38555 or 593 antibody (e.g., monoclonal antibody) can be used to isolate 21910, 56634, 55053, 2504, 15977, 14760, 25501, 17903, 3700, 21529, 26176, 26343, 56638, 18610, 33217, 21967, h1983, m1983, 38555 or 593 by standard techniques, such as affinity chromatography or immunoprecipitation. Moreover, an anti-21910, 56634, 55053, 2504, 15977, 14760, 25501, 17903, 3700, 21529, 26176, 26343, 56638, 18610, 33217, 21967, h1983, m1983, 38555 or 593 antibody can be used to detect 21910, 56634, 55053, 2504, 15977, 14760, 25501, 17903, 3700, 21529, 26176, 26343, 56638, 18610, 33217, 21967, h1983, m1983, 38555 or 593 protein (e.g., in a cellular lysate or cell supernatant) in order to evaluate the abundance and pattern of expression of the protein. Anti-21910, 56634, 55053, 2504, 15977, 14760, 25501, 17903, 3700, 21529, 26176, 26343, 56638, 18610, 33217, 21967, h1983, m1983, 38555 or 593 antibodies can be used diagnostically to monitor protein levels in tissue as part of a clinical testing procedure, e.g., to determine the efficacy of a given treatment regimen. Detection can be facilitated by coupling (i.e., physically linking) the antibody to a detectable substance (i.e., antibody labelling). Examples of detectable substances include various enzymes, prosthetic groups, fluorescent materials, luminescent materials, bioluminescent materials, and radioactive materials. Examples of suitable enzymes include horseradish peroxidase, alkaline phosphatase, β-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin, and examples of suitable radioactive material include $^{125}$I, $^{131}$I, $^{35}$S or $^{3}$H.

In preferred embodiments, an antibody can be made by immunizing with a purified 21910, 56634, 55053, 2504, 15977, 14760, 25501, 17903, 3700, 21529, 26176, 26343, 56638, 18610, 33217, 21967, h1983, m1983, 38555 or 593 antigen, or a fragment thereof, e.g., a fragment described herein, a membrane associated antigen, tissues, e.g., crude tissue preparations, whole cells, preferably living cells, lysed cells, or cell fractions, e.g., membrane fractions.

Antibodies which bind only a native 21910, 56634, 55053, 2504, 15977, 14760, 25501, 17903, 3700, 21529, 26176, 26343, 56638, 18610, 33217, 21967, h1983, m1983, 38555 or 593 protein, only denatured or otherwise non-native 21910, 56634, 55053, 2504, 15977, 14760, 25501, 17903, 3700, 21529, 26176, 26343, 56638, 18610, 33217, 21967, h1983, m1983, 38555 or 593 protein, or which bind both, are within the invention. Antibodies with linear or conformational epitopes are within the invention. Conformational epitopes sometimes can be identified by identifying antibodies which bind to native but not denatured 21910, 56634, 55053, 2504, 15977, 14760, 25501, 17903, 3700, 21529, 26176, 26343, 56638, 18610, 33217, 21967, h1983, m1983, 38555 or 593 protein.

Recombinant Expression Vectors, Host Cells and Genetically Engineered Cells

In another aspect, the invention includes, vectors, preferably expression vectors, containing a nucleic acid encoding a polypeptide described herein. As used herein, the term "vector" refers to a nucleic acid molecule capable of transporting another nucleic acid to which it has been linked and can include a plasmid, cosmid or viral vector. The vector can be capable of autonomous replication or it can integrate into a host DNA. Viral vectors include, e.g., replication defective retroviruses, adenoviruses and adeno-associated viruses.

A vector can include a 21910, 56634, 55053, 2504, 15977, 14760, 25501, 17903, 3700, 21529, 26176, 26343, 56638, 18610, 33217, 21967, h1983, m1983, 38555 or 593 nucleic acid in a form suitable for expression of the nucleic acid in a host cell.

Preferably the recombinant expression vector includes one or more regulatory sequences operatively linked to the nucleic acid sequence to be expressed. The term "regulatory sequence" includes promoters, enhancers and other expression control elements (e.g., polyadenylation signals). Regulatory sequences include those which direct constitutive expression of a nucleotide sequence, as well as tissue-specific regulatory and/or inducible sequences. The design of the expression vector can depend on such factors as the choice of the host cell to be transformed, the level of expression of protein desired, and the like. The expression vectors of the invention can be introduced into host cells to thereby produce proteins or polypeptides, including fusion proteins or polypeptides, encoded by nucleic acids as described herein (e.g., 21910, 56634, 55053, 2504, 15977, 14760, 25501, 17903, 3700, 21529, 26176, 26343, 56638, 18610, 33217, 21967, h1983, m1983, 38555 or 593 proteins, mutant forms of 21910, 56634, 55053, 2504, 15977, 14760, 25501, 17903, 3700, 21529, 26176, 26343, 56638, 18610, 33217, 21967, h1983, m1983, 38555 or 593 proteins, fusion proteins, and the like).

The recombinant expression vectors of the invention can be designed for expression of 21910, 56634, 55053, 2504, 15977, 14760, 25501, 17903, 3700, 21529, 26176, 26343, 56638, 18610, 33217, 21967, h1983, m1983, 38555 or 593 proteins in prokaryotic or eukaryotic cells. For example, polypeptides of the invention can be expressed in E. coli, insect cells (e.g., using baculovirus expression vectors), yeast cells or mammalian cells. Suitable host cells are discussed further in Goeddel, (1990) Gene Expression Technology: Methods in Enzymology 185, Academic Press, San Diego, Calif. Alternatively, the recombinant expression vector can be transcribed and translated in vitro, for example using T7 promoter regulatory sequences and T7 polymerase.

Expression of proteins in prokaryotes is most often carried out in E. coli with vectors containing constitutive or inducible promoters directing the expression of either fusion or non-fusion proteins. Fusion vectors add a number of amino acids to a protein encoded therein, usually to the amino terminus of the recombinant protein. Such fusion vectors typically serve three purposes: 1) to increase expression of recombinant protein; 2) to increase the solubility of the recombinant protein; and 3) to aid in the purification of the recombinant protein by acting as a ligand in affinity purification. Often, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase. Typical fusion expression vectors include pGEX (Pharmacia Biotech Inc; Smith and Johnson (1988) Gene 67:31-40), pMAL (New England Biolabs, Beverly, Mass.) and pRIT5 (Pharmacia, Piscataway, N.J.) which fuse glutathione S-transferase (GST), maltose E binding protein, or protein A, respectively, to the target recombinant protein.

Purified fusion proteins can be used in 21910, 56634, 55053, 2504, 15977, 14760, 25501, 17903, 3700, 21529, 26176, 26343, 56638, 18610, 33217, 21967, h1983, m1983, 38555 or 593 activity assays, (e.g., direct assays or competitive assays described in detail below), or to generate antibodies specific or selective for 21910, 56634, 55053, 2504, 15977, 14760, 25501, 17903, 3700, 21529, 26176, 26343, 56638, 18610, 33217, 21967, h1983, m1983, 38555 or 593 proteins. In a preferred embodiment, a fusion protein expressed in a retroviral expression vector of the present invention can be used to infect bone marrow cells which are subsequently transplanted into irradiated recipients. The pathology of the subject recipient is then examined after sufficient time has passed (e.g., six weeks).

To maximize recombinant protein expression in E. coli is to express the protein in a host bacteria with an impaired capacity to proteolytically cleave the recombinant protein (Gottesman (1990) Gene Expression Technology: Methods in Enzymology 185, Academic Press, San Diego, Calif. 119-128). Another strategy is to alter the nucleic acid sequence of the nucleic acid to be inserted into an expression vector so that the individual codons for each amino acid are those preferentially utilized in E. coli (Wada et al., (1992) Nucleic Acids Res. 20:2111-2118). Such alteration of nucleic acid sequences of the invention can be carried out by standard DNA synthesis techniques.

The 21910, 56634, 55053, 2504, 15977, 14760, 25501, 17903, 3700, 21529, 26176, 26343, 56638, 18610, 33217, 21967, h1983, m1983, 38555 or 593 expression vector can be a yeast expression vector, a vector for expression in insect cells, e.g., a baculovirus expression vector or a vector suitable for expression in mammalian cells.

When used in mammalian cells, the expression vector's control functions are often provided by viral regulatory elements. For example, commonly used promoters are derived from polyoma, Adenovirus 2, cytomegalovirus and Simian Virus 40.

In another embodiment, the recombinant mammalian expression vector is capable of directing expression of the nucleic acid preferentially in a particular cell type (e.g., tissue-specific regulatory elements are used to express the nucleic acid). Non-limiting examples of suitable tissue-specific promoters include the albumin promoter (liver-specific; Pinkert et al. (1987) Genes Dev. 1:268-277), lymphoid-specific promoters (Calame and Eaton (1988) Adv. Immunol. 43:235-275), in particular promoters of T cell receptors (Winoto and Baltimore (1989) EMBO J. 8:729-733) and immunoglobulins (Banerji et al. (1983) Cell 33:729-740; Queen and Baltimore (1983) Cell 33:741-748), neuron-specific promoters (e.g., the neurofilament promoter; Byrne and Ruddle (1989) Proc. Natl. Acad. Sci. USA 86:5473-5477), pancreas-specific promoters (Edlund et al. (1985) Science 230:912-916), and mammary gland-specific promoters (e.g., milk whey promoter; U.S. Pat. No. 4,873,316 and European Application Publication No. 264,166). Developmentally-regulated promoters are also encompassed, for example, the murine hox promoters (Kessel and Gruss (1990) Science 249:374-379) and the α-fetoprotein promoter (Campes and Tilghman (1989) Genes Dev. 3:537-546).

The invention further provides a recombinant expression vector comprising a DNA molecule of the invention cloned into the expression vector in an antisense orientation. Regulatory sequences (e.g., viral promoters and/or enhancers) operatively linked to a nucleic acid cloned in the antisense orientation can be chosen which direct the constitutive, tissue specific or cell type specific expression of antisense RNA in a variety of cell types. The antisense expression vector can be in the form of a recombinant plasmid, phagemid or attenuated virus. For a discussion of the regulation of gene expression using antisense genes see Weintraub et al., (1986) Reviews—Trends in Genetics 1:1.

Another aspect the invention provides a host cell which includes a nucleic acid molecule described herein, e.g., a 21910, 56634, 55053, 2504, 15977, 14760, 25501, 17903, 3700, 21529, 26176, 26343, 56638, 18610, 33217, 21967, h1983, m1983, 38555 or 593 nucleic acid molecule within a recombinant expression vector or a 21910, 56634, 55053, 2504, 15977, 14760, 25501, 17903, 3700, 21529, 26176, 26343, 56638, 18610, 33217, 21967, h1983, m1983, 38555 or 593 nucleic acid molecule containing sequences which allow it to homologously recombine into a specific site of the host cell's genome. The terms "host cell" and "recombinant host cell" are used interchangeably herein. Such terms refer not only to the particular subject cell but to the progeny or potential progeny of such a cell. Because certain modifications can occur in succeeding generations due to either mutation or environmental influences, such progeny may not, in fact, be identical to the parent cell, but are still included within the scope of the term as used herein.

A host cell can be any prokaryotic or eukaryotic cell. For example, a 21910, 56634, 55053, 2504, 15977, 14760, 25501, 17903, 3700, 21529, 26176, 26343, 56638, 18610, 33217, 21967, h1983, m1983, 38555 or 593 protein can be expressed in bacterial cells such as E. coli, insect cells, yeast or mammalian cells (such as Chinese hamster ovary (CHO) cells or CV-1 origin, SV-40 (COS) cells). Other suitable host cells are known to those skilled in the art.

Vector DNA can be introduced into host cells via conventional transformation or transfection techniques. As used herein, the terms "transformation" and "transfection" are intended to refer to a variety of art-recognized techniques for introducing foreign nucleic acid (e.g., DNA) into a host cell, including calcium phosphate or calcium chloride co-precipitation, DEAE-dextran-mediated transfection, lipofection, or electroporation.

A host cell of the invention can be used to produce (i.e., express) a 21910, 56634, 55053, 2504, 15977, 14760, 25501, 17903, 3700, 21529, 26176, 26343, 56638, 18610, 33217, 21967, h1983, m1983, 38555 or 593 protein. Accordingly, the invention further provides methods for producing a 21910, 56634, 55053, 2504, 15977, 14760, 25501, 17903, 3700, 21529, 26176, 26343, 56638, 18610, 33217, 21967, h1983, m1983, 38555 or 593 protein using the host cells of the invention. In one embodiment, the method includes culturing the host cell of the invention (into which a recombinant expression vector encoding a 21910, 56634, 55053, 2504, 15977, 14760, 25501, 17903, 3700, 21529, 26176, 26343, 56638, 18610, 33217, 21967, h1983, m1983, 38555 or 593 protein has been introduced) in a suitable medium such that a 21910, 56634, 55053, 2504, 15977, 14760, 25501, 17903, 3700, 21529, 26176, 26343, 56638, 18610, 33217, 21967, h1983, m1983, 38555 or 593 protein is produced. In another embodiment, the method further includes isolating a 21910, 56634, 55053, 2504, 15977, 14760, 25501, 17903, 3700, 21529, 26176, 26343, 56638, 18610, 33217, 21967, h1983, m1983, 38555 or 593 protein from the medium or the host cell.

In another aspect, the invention features, a cell or purified preparation of cells which include a 21910, 56634, 55053, 2504, 15977, 14760, 25501, 17903, 3700, 21529, 26176, 26343, 56638, 18610, 33217, 21967, h1983, m1983, 38555 or 593 transgene, or which otherwise misexpress 21910, 56634, 55053, 2504, 15977, 14760, 25501, 17903, 3700, 21529, 26176, 26343, 56638, 18610, 33217, 21967, h1983, m1983, 38555 or 593. The cell preparation can consist of human or non-human cells, e.g., rodent cells, e.g., mouse or rat cells, rabbit cells, or pig cells. In preferred embodiments, the cell or cells include a 21910, 56634, 55053, 2504, 15977, 14760, 25501, 17903, 3700, 21529, 26176, 26343, 56638, 18610, 33217, 21967, h1983, m1983, 38555 or 593 transgene, e.g., a heterologous form of a 21910, 56634, 55053, 2504, 15977, 14760, 25501, 17903, 3700, 21529, 26176, 26343, 56638, 18610, 33217, 21967, h1983, m1983, 38555 or 593, e.g., a gene derived from humans (in the case of a non-human cell). The 21910, 56634, 55053, 2504, 15977, 14760, 25501, 17903, 3700, 21529, 26176, 26343, 56638, 18610, 33217, 21967, h1983, m1983, 38555 or 593 transgene can be misexpressed, e.g., overexpressed or underexpressed. In other preferred embodiments, the cell or cells include a gene which misexpresses an endogenous 21910, 56634, 55053, 2504, 15977, 14760, 25501, 17903, 3700, 21529, 26176, 26343, 56638, 18610, 33217, 21967, h1983, m1983, 38555 or 593, e.g., a gene the expression of which is disrupted, e.g., a knockout. Such cells can serve as a model for studying disorders which are related to mutated or misexpressed 21910, 56634, 55053, 2504, 15977, 14760, 25501, 17903, 3700, 21529, 26176, 26343, 56638, 18610, 33217, 21967, h1983, m1983, 38555 or 593 alleles or for use in drug screening.

In another aspect, the invention features, a human cell, e.g., a hematopoietic stem cell, transformed with nucleic acid which encodes a subject 21910, 56634, 55053, 2504, 15977, 14760, 25501, 17903, 3700, 21529, 26176, 26343, 56638, 18610, 33217, 21967, h1983, m1983, 38555 or 593 polypeptide.

Also provided are cells, preferably human cells, e.g., human hematopoietic or fibroblast cells, in which an endogenous 21910, 56634, 55053, 2504, 15977, 14760, 25501, 17903, 3700, 21529, 26176, 26343, 56638, 18610, 33217, 21967, h1983, m1983, 38555 or 593 is under the control of a regulatory sequence that does not normally control the expression of the endogenous 21910, 56634, 55053, 2504, 15977, 14760, 25501, 17903, 3700, 21529, 26176, 26343, 56638, 18610, 33217, 21967, h1983, m1983, 38555 or 593 gene. The expression characteristics of an endogenous gene within a cell, e.g., a cell line or microorganism, can be modified by inserting a heterologous DNA regulatory element into the genome of the cell such that the inserted regulatory element is operably linked to the endogenous 21910, 56634, 55053, 2504, 15977, 14760, 25501, 17903, 3700, 21529, 26176, 26343, 56638, 18610, 33217, 21967, h1983, m1983, 38555 or 593 gene. For example, an endogenous 21910, 56634, 55053, 2504, 15977, 14760, 25501, 17903, 3700, 21529, 26176, 26343, 56638, 18610, 33217, 21967, h1983, m1983, 38555 or 593 gene which is "transcriptionally silent," e.g., not normally expressed, or expressed only at very low levels, can be activated by inserting a regulatory element which is capable of promoting the expression of a normally expressed gene product in that cell. Techniques such as targeted homologous recombinations, can be used to insert the heterologous DNA as described in, e.g., Chappel, U.S. Pat. No. 5,272,071; WO 91/06667, published in May 16, 1991.

Transgenic Animals

The invention provides non-human transgenic animals. Such animals are useful for studying the function and/or activity of a 21910, 56634, 55053, 2504, 15977, 14760, 25501, 17903, 3700, 21529, 26176, 26343, 56638, 18610, 33217, 21967, h1983, m1983, 38555 or 593 protein and for identifying and/or evaluating modulators of 21910, 56634, 55053, 2504, 15977, 14760, 25501, 17903, 3700, 21529, 26176, 26343, 56638, 18610, 33217, 21967, h1983, m1983, 38555 or 593 activity. As used herein, a "transgenic animal" is a non-human animal, preferably a mammal, more preferably a rodent such as a rat or mouse, in which one or more of the cells of the animal includes a transgene. Other examples of transgenic animals include non-human primates, sheep, dogs, cows, goats, chickens, amphibians, and the like. A transgene is exogenous DNA or a rearrangement, e.g., a deletion of endogenous chromosomal DNA, which preferably is integrated into or occurs in the genome of the cells of a transgenic animal. A transgene can direct the expression of an encoded gene product in one or more cell types or tissues of the transgenic animal, other transgenes, e.g., a knockout, reduce expression. Thus, a transgenic animal can be one in which an endogenous 21910, 56634, 55053, 2504, 15977, 14760, 25501, 17903, 3700, 21529, 26176, 26343, 56638, 18610, 33217, 21967, h1983, m1983, 38555 or 593 gene has been altered by, e.g., by homologous recombination between the endogenous gene and an exogenous DNA molecule introduced into a cell of the animal, e.g., an embryonic cell of the animal, prior to development of the animal.

Intronic sequences and polyadenylation signals can also be included in the transgene to increase the efficiency of expression of the transgene. A tissue-specific regulatory sequence(s) can be operably linked to a transgene of the invention to direct expression of a 21910, 56634, 55053, 2504, 15977, 14760, 25501, 17903, 3700, 21529, 26176, 26343, 56638, 18610, 33217, 21967, h1983, m1983, 38555 or 593 protein to particular cells. A transgenic founder animal can be identified based upon the presence of a 21910, 56634, 55053, 2504, 15977, 14760, 25501, 17903, 3700, 21529, 26176, 26343, 56638, 18610, 33217, 21967, h1983, m1983, 38555 or 593 transgene in its genome and/or expression of 21910, 56634, 55053, 2504, 15977, 14760, 25501, 17903, 3700, 21529, 26176, 26343, 56638, 18610, 33217, 21967, h1983, m1983, 38555 or 593 mRNA in tissues or cells of the animals. A transgenic founder animal can then be used to breed additional animals carrying the transgene. Moreover, transgenic animals carrying a transgene encoding a 21910, 56634, 55053, 2504, 15977, 14760, 25501, 17903, 3700, 21529, 26176, 26343, 56638, 18610, 33217, 21967, h1983, m1983, 38555 or 593 protein can further be bred to other transgenic animals carrying other transgenes.

21910, 56634, 55053, 2504, 15977, 14760, 25501, 17903, 3700, 21529, 26176, 26343, 56638, 18610, 33217, 21967, h1983, m1983, 38555 or 593 proteins or polypeptides can be expressed in transgenic animals or plants, e.g., a nucleic acid encoding the protein or polypeptide can be introduced into the genome of an animal. In preferred embodiments the nucleic acid is placed under the control of a tissue specific promoter, e.g., a milk or egg specific promoter, and recovered from the milk or eggs produced by the animal. Suitable animals are mice, pigs, cows, goats, and sheep.

The invention also includes a population of cells from a transgenic animal, as discussed, e.g., below.

Uses

The nucleic acid molecules, proteins, protein homologs, and antibodies described herein can be used in one or more of the following methods: a) screening assays; b) predictive medicine (e.g., diagnostic assays, prognostic assays, monitoring clinical trials, and pharmacogenetics); and c) methods of treatment (e.g., therapeutic and prophylactic). The isolated nucleic acid molecules of the invention can be used, for example, to express a 21910, 56634, 55053, 2504, 15977, 14760, 25501, 17903, 3700, 21529, 26176, 26343, 56638, 18610, 33217, 21967, h1983, m1983, 38555 or 593 protein (e.g., via a recombinant expression vector in a host cell in gene therapy applications), to detect a 21910, 56634, 55053, 2504, 15977, 14760, 25501, 17903, 3700, 21529, 26176, 26343, 56638, 18610, 33217, 21967, h1983, m1983, 38555 or 593 mRNA (e.g., in a biological sample) or a genetic alteration in a 21910, 56634, 55053, 2504, 15977, 14760, 25501, 17903, 3700, 21529, 26176, 26343, 56638, 18610, 33217, 21967, h1983, m1983, 38555 or 593 gene, and to modulate 21910, 56634, 55053, 2504, 15977, 14760, 25501, 17903, 3700, 21529, 26176, 26343, 56638, 18610, 33217, 21967, h1983, m1983, 38555 or 593 activity, as described further below. The 21910, 56634, 55053, 2504, 15977, 14760, 25501, 17903, 3700, 21529, 26176, 26343, 56638, 18610, 33217, 21967, h1983, m1983, 38555 or 593 proteins can be used to treat disorders characterized by insufficient or excessive production of a 21910, 56634, 55053, 2504, 15977, 14760, 25501, 17903, 3700, 21529, 26176, 26343, 56638, 18610, 33217, 21967, h1983, m1983, 38555 or 593 substrate or production of 21910, 56634, 55053, 2504, 15977, 14760, 25501, 17903, 3700, 21529, 26176, 26343, 56638, 18610, 33217, 21967, h1983, m1983, 38555 or 593 inhibitors. In addition, the 21910, 56634, 55053, 2504, 15977, 14760, 25501, 17903, 3700, 21529, 26176, 26343, 56638, 18610, 33217, 21967, h1983, m1983, 38555 or 593 proteins can be used to screen for naturally occurring 21910, 56634, 55053, 2504, 15977, 14760, 25501, 17903, 3700, 21529, 26176, 26343, 56638, 18610, 33217, 21967, h1983, m1983, 38555 or 593 substrates, to screen for drugs or compounds which modulate 21910, 56634, 55053, 2504, 15977, 14760, 25501, 17903, 3700, 21529, 26176, 26343, 56638, 18610, 33217, 21967, h1983, m1983, 38555 or 593 activity, as well as to treat disorders characterized by insufficient or excessive production of 21910, 56634, 55053, 2504, 15977, 14760, 25501, 17903, 3700, 21529, 26176, 26343, 56638, 18610, 33217, 21967, h1983, m1983, 38555 or 593 protein or production of 21910, 56634, 55053, 2504, 15977, 14760, 25501, 17903, 3700, 21529, 26176, 26343, 56638, 18610, 33217, 21967, h1983, m1983, 38555 or 593 protein forms which have decreased, aberrant or unwanted activity compared to 21910, 56634, 55053, 2504, 15977, 14760, 25501, 17903, 3700, 21529, 26176, 26343, 56638, 18610, 33217, 21967, h1983, m1983, 38555 or 593 wild type protein (e.g., aberrant or deficient guanylate kinase activity, phophatidylinositol 4-phosphate 5-kinase activity, kinase activity, transferase activity, aminopeptidase activity, adenylate cyclase activity, calpain protease activity, oxidoreductase activity, neprilysin protease activity, AMP binding enzyme activity and lysyl oxidase activity, or other activity). Moreover, the anti-21910, 56634, 55053, 2504, 15977, 14760, 25501, 17903, 3700, 21529, 26176, 26343, 56638, 18610, 33217, 21967, h1983, m1983, 38555 or 593 antibodies of the invention can be used to detect and isolate 21910, 56634, 55053, 2504, 15977, 14760, 25501, 17903, 3700, 21529, 26176, 26343, 56638, 18610, 33217, 21967, h1983, m1983, 38555 or 593 proteins, regulate the bioavailability of 21910, 56634, 55053, 2504, 15977, 14760, 25501, 17903, 3700, 21529, 26176, 26343, 56638, 18610, 33217, 21967, h1983, m1983, 38555 or 593 proteins, and modulate 21910, 56634, 55053, 2504, 15977, 14760, 25501, 17903, 3700, 21529, 26176, 26343, 56638, 18610, 33217, 21967, h1983, m1983, 38555 or 593 activity.

A method of evaluating a compound for the ability to interact with, e.g., bind, a subject 21910, 56634, 55053, 2504, 15977, 14760, 25501, 17903, 3700, 21529, 26176, 26343, 56638, 18610, 33217, 21967, h1983, m1983, 38555 or 593 polypeptide is provided. The method includes: contacting the compound with the subject 21910, 56634, 55053, 2504, 15977, 14760, 25501, 17903, 3700, 21529, 26176, 26343, 56638, 18610, 33217, 21967, h1983, m1983, 38555 or 593 polypeptide; and evaluating ability of the compound to interact with, e.g., to bind or form a complex with the subject 21910, 56634, 55053, 2504, 15977, 14760, 25501, 17903, 3700, 21529, 26176, 26343, 56638, 18610, 33217, 21967, h1983, m1983, 38555 or 593 polypeptide. This method can be performed in vitro, e.g., in a cell free system, or in vivo, e.g., in a two-hybrid interaction trap assay. This method can be used to identify naturally occurring molecules which interact with subject 21910, 56634, 55053, 2504, 15977, 14760, 25501, 17903, 3700, 21529, 26176, 26343, 56638, 18610, 33217, 21967, h1983, m1983, 38555 or 593 polypeptide. It can also be used to find natural or synthetic inhibitors of subject 21910, 56634, 55053, 2504, 15977, 14760, 25501, 17903, 3700, 21529, 26176, 26343, 56638, 18610, 33217, 21967, h1983, m1983, 38555 or 593 polypeptide. Screening methods are discussed in more detail below.

Screening Assays

The invention provides methods (also referred to herein as "screening assays") for identifying modulators, i.e., candidate or test compounds or agents (e.g., proteins, peptides, peptidomimetics, peptoids, small molecules or other drugs) which bind to 21910, 56634, 55053, 2504, 15977, 14760, 25501, 17903, 3700, 21529, 26176, 26343, 56638, 18610, 33217, 21967, h1983, m1983, 38555 or 593 proteins, have a stimulatory or inhibitory effect on, for example, 21910, 56634, 55053, 2504, 15977, 14760, 25501, 17903, 3700, 21529, 26176, 26343, 56638, 18610, 33217, 21967, h1983, m1983, 38555 or 593 expression or 21910, 56634, 55053, 2504, 15977, 14760, 25501, 17903, 3700, 21529, 26176, 26343, 56638, 18610, 33217, 21967, h1983, m1983, 38555 or 593 activity, or have a stimulatory or inhibitory effect on, for example, the expression or activity of a 21910, 56634, 55053, 2504, 15977, 14760, 25501, 17903, 3700, 21529, 26176, 26343, 56638, 18610, 33217, 21967, h1983, m1983, 38555 or 593 substrate. Compounds thus identified can be used to modulate the activity of target gene products (e.g., 21910, 56634, 55053, 2504, 15977, 14760, 25501, 17903, 3700, 21529, 26176, 26343, 56638, 18610, 33217, 21967, h1983, m1983, 38555 or 593 genes) in a therapeutic protocol, to elaborate the biological function of the target gene product, or to identify compounds that disrupt normal target gene interactions.

In one embodiment, the invention provides assays for screening candidate or test compounds which are substrates of a 21910, 56634, 55053, 2504, 15977, 14760, 25501, 17903, 3700, 21529, 26176, 26343, 56638, 18610, 33217, 21967, h1983, m1983, 38555 or 593 protein or polypeptide or a biologically active portion thereof. In another embodiment, the invention provides assays for screening candidate or test compounds which bind to or modulate the activity of a 21910, 56634, 55053, 2504, 15977, 14760, 25501, 17903, 3700, 21529, 26176, 26343, 56638, 18610, 33217, 21967, h1983, m1983, 38555 or 593 protein or polypeptide or a biologically active portion thereof.

The test compounds of the present invention can be obtained using any of the numerous approaches in combinatorial library methods known in the art, including: biological libraries; peptoid libraries (libraries of molecules having the functionalities of peptides, but with a novel, non-peptide backbone which are resistant to enzymatic degradation but which nevertheless remain bioactive; see, e.g., Zuckermann et al. (1994) *J. Med. Chem.* 37:2678-85); spatially addressable parallel solid phase or solution phase libraries; synthetic library methods requiring deconvolution; the 'one-bead one-compound' library method; and synthetic library methods using affinity chromatography selection. The biological library and peptoid library approaches are limited to peptide libraries, while the other four approaches are applicable to peptide, non-peptide oligomer or small molecule libraries of compounds (Lam (1997) *Anticancer Drug Des.* 12:145).

Examples of methods for the synthesis of molecular libraries can be found in the art, for example in: DeWitt et al. (1993) *Proc. Natl. Acad. Sci. U.S.A.* 90:6909-13; Erb et al. (1994) *Proc. Natl. Acad. Sci. USA* 91:11422-426; Zuckermann et al. (1994). *J. Med. Chem.* 37:2678-85; Cho et al. (1993) *Science* 261:1303; Carrell et al. (1994) *Angew. Chem. Int. Ed. Engl.* 33:2059; Carrell et al. (1994) *Angew. Chem. Int. Ed. Engl.* 33:2061; and in Gallop et al. (1994) *J. Med. Chem.* 37:1233-51.

Libraries of compounds can be presented in solution (e.g., Houghten (1992) *Biotechniques* 13:412-421), or on beads (Lam (1991) *Nature* 354:82-84), chips (Fodor (1993) *Nature* 364:555-556), bacteria (Ladner, U.S. Pat. No. 5,223,409), spores (Ladner U.S. Pat. No. '409), plasmids (Cull et al. (1992) *Proc Natl Acad Sci USA* 89:1865-1869) or on phage (Scott and Smith (1990) *Science* 249:386-390; Devlin (1990) *Science* 249:404-406; Cwirla et al. (1990) *Proc. Natl. Acad. Sci.* 87:6378-6382; Felici (1991) *J. Mol. Biol.* 222:301-310; Ladner supra.).

In one embodiment, an assay is a cell-based assay in which a cell which expresses a 21910, 56634, 55053, 2504, 15977, 14760, 25501, 17903, 3700, 21529, 26176, 26343, 56638, 18610, 33217, 21967, h1983, m1983, 38555 or 593 protein or biologically active portion thereof is contacted with a test compound, and the ability of the test compound to modulate 21910, 56634, 55053, 2504, 15977, 14760, 25501, 17903, 3700, 21529, 26176, 26343, 56638, 18610, 33217, 21967, h1983, m1983, 38555 or 593 activity is determined. Determining the ability of the test compound to modulate 21910, 56634, 55053, 2504, 15977, 14760, 25501, 17903, 3700, 21529, 26176, 26343, 56638, 18610, 33217, 21967, h1983, m1983, 38555 or 593 activity can be accomplished by monitoring, for example, guanylate kinase activity, phophatidylinositol 4-phosphate 5-kinase activity, kinase activity, transferase activity, aminopeptidase activity, adenylate cyclase activity, calpain protease activity, oxidoreductase activity, neprilysin protease activity, AMP binding enzyme activity and lysyl oxidase activity, or other activity. The cell, for example, can be of mammalian origin, e.g., human.

The ability of the test compound to modulate 21910, 56634, 55053, 2504, 15977, 14760, 25501, 17903, 3700, 21529, 26176, 26343, 56638, 18610, 33217, 21967, h1983, m1983, 38555 or 593 binding to a compound, e.g., a 21910, 56634, 55053, 2504, 15977, 14760, 25501, 17903, 3700, 21529, 26176, 26343, 56638, 18610, 33217, 21967, h1983, m1983, 38555 or 593 substrate, or to bind to 21910, 56634, 55053, 2504, 15977, 14760, 25501, 17903, 3700, 21529, 26176, 26343, 56638, 18610, 33217, 21967, h1983, m1983, 38555 or 593 can also be evaluated. This can be accomplished, for example, by coupling the compound, e.g., the substrate, with a radioisotope or enzymatic label such that binding of the compound, e.g., the substrate, to 21910, 56634, 55053, 2504, 15977, 14760, 25501, 17903, 3700, 21529, 26176, 26343, 56638, 18610, 33217, 21967, h1983, m1983, 38555 or 593 can be determined by detecting the labeled compound, e.g., substrate, in a complex. Alternatively, 21910, 56634, 55053, 2504, 15977, 14760, 25501, 17903, 3700, 21529, 26176, 26343, 56638, 18610, 33217, 21967, h1983, m1983, 38555 or 593 could be coupled with a radioisotope or enzymatic label to monitor the ability of a test compound to modulate 21910, 56634, 55053, 2504, 15977, 14760, 25501, 17903, 3700, 21529, 26176, 26343, 56638, 18610, 33217, 21967, h1983, m1983, 38555 or 593 binding to a 21910, 56634, 55053, 2504, 15977, 14760, 25501, 17903, 3700, 21529, 26176, 26343, 56638, 18610, 33217, 21967, h1983, m1983, 38555 or 593 substrate in a complex. For example, compounds (e.g., 21910, 56634, 55053, 2504, 15977, 14760, 25501, 17903, 3700, 21529, 26176, 26343, 56638, 18610, 33217, 21967, h1983, m1983, 38555 or 593 substrates) can be labeled with $^{125}I$, $^{14}C$, $^{35}S$ or $^{3}H$., either directly or indirectly, and the radioisotope detected by direct counting of radioemission or by scintillation counting. Alternatively, compounds can be enzymatically labeled with, for example, horseradish peroxidase, alkaline phosphatase, or luciferase, and the enzymatic label detected by determination of conversion of an appropriate substrate to product.

The ability of a compound (e.g., a 21910, 56634, 55053, 2504, 15977, 14760, 25501, 17903, 3700, 21529, 26176, 26343, 56638, 18610, 33217, 21967, h1983, m1983, 38555 or 593 substrate) to interact with 21910, 56634, 55053, 2504, 15977, 14760, 25501, 17903, 3700, 21529, 26176, 26343, 56638, 18610, 33217, 21967, h1983, m1983, 38555 or 593 with or without the labeling of any of the interactants can be evaluated. For example, a microphysiometer can be used to detect the interaction of a compound with 21910, 56634, 55053, 2504, 15977, 14760, 25501, 17903, 3700, 21529, 26176, 26343, 56638, 18610, 33217, 21967, h1983, m1983, 38555 or 593 without the labeling of either the compound or the 21910, 56634, 55053, 2504, 15977, 14760, 25501, 17903, 3700, 21529, 26176, 26343, 56638, 18610, 33217, 21967, h1983, m1983, 38555 or 593. McConnell et al. (1992) *Science* 257:1906-1912. As used herein, a "microphysiometer" (e.g., Cytosensor) is an analytical instrument that measures the rate at which a cell acidifies its environment using a light-addressable potentiometric sensor (LAPS). Changes in this acidification rate can be used as an indicator of the interaction between a compound and 21910, 56634, 55053, 2504, 15977, 14760, 25501, 17903, 3700, 21529, 26176, 26343, 56638, 18610, 33217, 21967, h1983, m1983, 38555 or 593.

In yet another embodiment, a cell-free assay is provided in which a 21910, 56634, 55053, 2504, 15977, 14760, 25501, 17903, 3700, 21529, 26176, 26343, 56638, 18610, 33217, 21967, h1983, m1983, 38555 or 593 protein or biologically active portion thereof is contacted with a test compound and the ability of the test compound to bind to the 21910, 56634, 55053, 2504, 15977, 14760, 25501, 17903, 3700, 21529, 26176, 26343, 56638, 18610, 33217, 21967, h1983, m1983, 38555 or 593 protein or biologically active portion thereof is evaluated. Preferred biologically active portions of the 21910, 56634, 55053, 2504, 15977, 14760, 25501, 17903, 3700, 21529, 26176, 26343, 56638, 18610, 33217, 21967, h1983, m1983, 38555 or 593 proteins to be used in assays of the present invention include fragments which participate in interactions with non-21910, 56634, 55053, 2504, 15977, 14760, 25501, 17903, 3700, 21529, 26176, 26343, 56638, 18610, 33217, 21967, h1983, m1983, 38555 or 593 molecules, e.g., fragments with high surface probability scores.

Soluble and/or membrane-bound forms of isolated proteins (e.g., 21910, 56634, 55053, 2504, 15977, 14760, 25501, 17903, 3700, 21529, 26176, 26343, 56638, 18610, 33217, 21967, h1983, m1983, 38555 or 593 proteins or biologically active portions thereof) can be used in the cell-free assays of the invention. When membrane-bound forms of the protein are used, it may be desirable to utilize a solubilizing agent. Examples of such solubilizing agents include non-ionic detergents such as n-octylglucoside, n-dodecylglucoside, n-dodecylmaltoside, octanoyl-N-methylglucamide, decanoyl-N-methylglucamide, Triton® X-100, Triton® X-114, Thesit®, Isotridecypoly(ethylene glycol ether)$_n$, 3-[(3-cholamidopropyl)dimethylamminio]-1-propane sulfonate (CHAPS), 3-[(3-cholamidopropyl)dimethylamminio]-2-hydroxy-1-propane sulfonate (CHAPSO), or N-dodecyl=N,N-dimethyl-3-ammonio-1-propane sulfonate.

Cell-free assays involve preparing a reaction mixture of the target gene protein and the test compound under conditions and for a time sufficient to allow the two components to interact and bind, thus forming a complex that can be removed and/or detected.

The interaction between two molecules can also be detected, e.g., using fluorescence energy transfer (FET) (see, for example, Lakowicz et al., U.S. Pat. No. 5,631,169; Stavrianopoulos, et al., U.S. Pat. No. 4,868,103). A fluorophore label on the first, 'donor' molecule is selected such that its emitted fluorescent energy will be absorbed by a fluorescent label on a second, 'acceptor' molecule, which in turn is able to fluoresce due to the absorbed energy. Alternately, the 'donor' protein molecule can simply utilize the natural fluorescent energy of tryptophan residues. Labels are chosen that emit different wavelengths of light, such that the 'acceptor' molecule label can be differentiated from that of the 'donor'. Since the efficiency of energy transfer between the labels is related to the distance separating the molecules, the spatial relationship between the molecules can be assessed. In a situation in which binding occurs between the molecules, the fluorescent emission of the 'acceptor' molecule label in the assay should be maximal. An FET binding event can be conveniently measured through standard fluorometric detection means well known in the art (e.g., using a fluorimeter).

In another embodiment, determining the ability of the 21910, 56634, 55053, 2504, 15977, 14760, 25501, 17903, 3700, 21529, 26176, 26343, 56638, 18610, 33217, 21967, h1983, m1983, 38555 or 593 protein to bind to a target molecule can be accomplished using real-time Biomolecular Interaction Analysis (BIA) (see, e.g., Sjolander and Urbaniczky (1991) *Anal. Chem.* 63:2338-2345 and Szabo et al. (1995) *Curr. Opin. Struct. Biol.* 5:699-705). "Surface plasmon resonance" or "BIA" detects biospecific interactions in real time, without labeling any of the interactants (e.g., BIAcore). Changes in the mass at the binding surface (indicative of a binding event) result in alterations of the refractive index of light near the surface (the optical phenomenon of surface plasmon resonance (SPR)), resulting in a detectable signal which can be used as an indication of real-time reactions between biological molecules.

In one embodiment, the target gene product or the test substance is anchored onto a solid phase. The target gene product/test compound complexes anchored on the solid phase can be detected at the end of the reaction. Preferably, the target gene product can be anchored onto a solid surface, and the test compound, (which is not anchored), can be labeled, either directly or indirectly, with detectable labels discussed herein.

It may be desirable to immobilize either 21910, 56634, 55053, 2504, 15977, 14760, 25501, 17903, 3700, 21529, 26176, 26343, 56638, 18610, 33217, 21967, h1983, m1983, 38555 or 593, an anti-21910, 56634, 55053, 2504, 15977, 14760, 25501, 17903, 3700, 21529, 26176, 26343, 56638, 18610, 33217, 21967, h1983, m1983, 38555 or 593 antibody or its target molecule to facilitate separation of complexed from uncomplexed forms of one or both of the proteins, as well as to accommodate automation of the assay. Binding of a test compound to a 21910, 56634, 55053, 2504, 15977, 14760, 25501, 17903, 3700, 21529, 26176, 26343, 56638, 18610, 33217, 21967, h1983, m1983, 38555 or 593 protein, or interaction of a 21910, 56634, 55053, 2504, 15977, 14760, 25501, 17903, 3700, 21529, 26176, 26343, 56638, 18610, 33217, 21967, h1983, m1983, 38555 or 593 protein with a target molecule in the presence and absence of a candidate compound, can be accomplished in any vessel suitable for containing the reactants. Examples of such vessels include microtiter plates, test tubes, and micro-centrifuge tubes. In one embodiment, a fusion protein can be provided which adds a domain that allows one or both of the proteins to be bound to a matrix. For example, glutathione-S-transferase/21910, 56634, 55053, 2504, 15977, 14760, 25501, 17903, 3700, 21529, 26176, 26343, 56638, 18610, 33217, 21967, h1983, m1983, 38555 or 593 fusion proteins or glutathione-S-transferase/target fusion proteins can be adsorbed onto glutathione sepharose beads (Sigma Chemical, St. Louis, Mo.) or glutathione derivatized microtiter plates, which are then combined with the test compound or the test compound and either the non-adsorbed target protein or 21910, 56634, 55053, 2504, 15977, 14760, 25501, 17903, 3700, 21529, 26176, 26343, 56638, 18610, 33217, 21967, h1983, m1983, 38555 or 593 protein, and the mixture incubated under conditions conducive to complex formation (e.g., at physiological conditions for salt and pH).

Following incubation, the beads or microtiter plate wells are washed to remove any unbound components, the matrix immobilized in the case of beads, complex determined either directly or indirectly, for example, as described above. Alternatively, the complexes can be dissociated from the matrix, and the level of 21910, 56634, 55053, 2504, 15977, 14760, 25501, 17903, 3700, 21529, 26176, 26343, 56638, 18610, 33217, 21967, h1983, m1983, 38555 or 593 binding or activity determined using standard techniques.

Other techniques for immobilizing either a 21910, 56634, 55053, 2504, 15977, 14760, 25501, 17903, 3700, 21529, 26176, 26343, 56638, 18610, 33217, 21967, h1983, m1983, 38555 or 593 protein or a target molecule on matrices include using conjugation of biotin and streptavidin. Biotinylated 21910, 56634, 55053, 2504, 15977, 14760, 25501, 17903, 3700, 21529, 26176, 26343, 56638, 18610, 33217, 21967, h1983, m1983, 38555 or 593 protein or target molecules can be prepared from biotin-NHS(N-hydroxy-succinimide) using techniques known in the art (e.g., biotinylation kit, Pierce Chemicals, Rockford, Ill.), and immobilized in the wells of streptavidin-coated 96 well plates (Pierce Chemical).

In order to conduct the assay, the non-immobilized component is added to the coated surface containing the anchored component. After the reaction is complete, unreacted components are removed (e.g., by washing) under conditions such that any complexes formed will remain immobilized on the solid surface. The detection of complexes anchored on the solid surface can be accomplished in a number of ways. Where the previously non-immobilized component is pre-labeled, the detection of label immobilized on the surface indicates that complexes were formed. Where the previously non-immobilized component is not pre-labeled, an indirect label can be used to detect complexes anchored on the surface; e.g., using a labeled antibody specific or selective for the immobilized component (the antibody, in turn, can be directly labeled or indirectly labeled with, e.g., a labeled anti-Ig antibody).

In one embodiment, this assay is performed utilizing antibodies reactive with 21910, 56634, 55053, 2504, 15977, 14760, 25501, 17903, 3700, 21529, 26176, 26343, 56638, 18610, 33217, 21967, h1983, m1983, 38555 or 593 protein or target molecules but which do not interfere with binding of the 21910, 56634, 55053, 2504, 15977, 14760, 25501, 17903, 3700, 21529, 26176, 26343, 56638, 18610, 33217, 21967, h1983, m1983, 38555 or 593 protein to its target molecule. Such antibodies can be derivatized to the wells of the plate, and unbound target or 21910, 56634, 55053, 2504, 15977, 14760, 25501, 17903, 3700, 21529, 26176, 26343, 56638, 18610, 33217, 21967, h1983, m1983, 38555 or 593 protein trapped in the wells by antibody conjugation. Methods for detecting such complexes, in addition to those described above for the GST-immobilized complexes, include immunodetection of complexes using antibodies reactive with the 21910, 56634, 55053, 2504, 15977, 14760, 25501, 17903, 3700, 21529, 26176, 26343, 56638, 18610, 33217, 21967, h1983, m1983, 38555 or 593 protein or target molecule, as well as enzyme-linked assays which rely on detecting an enzymatic activity associated with the 21910, 56634, 55053, 2504, 15977, 14760, 25501, 17903, 3700, 21529, 26176, 26343, 56638, 18610, 33217, 21967, h1983, m1983, 38555 or 593 protein or target molecule.

Alternatively, cell free assays can be conducted in a liquid phase. In such an assay, the reaction products are separated from unreacted components, by any of a number of standard techniques, including but not limited to: differential centrifugation (see, for example, Rivas and Minton (1993) *Trends Biochem Sci* 18:284-7); chromatography (gel filtration chromatography, ion-exchange chromatography); electrophoresis (see, e.g., Ausubel et al., eds. (1999) *Current Protocols in Molecular Biology*, J. Wiley, New York.); and immunoprecipitation (see, for example, Ausubel et al., eds. (1999) *Current Protocols in Molecular Biology*, J. Wiley, New York). Such resins and chromatographic techniques are known to one skilled in the art (see, e.g., Heegaard (1998) *J Mol Recognit* 11:141-8; Hage and Tweed (1997) *J Chromatogr B Biomed Sci Appl.* 699:499-525). Further, fluorescence energy transfer can also be conveniently utilized, as described herein, to detect binding without further purification of the complex from solution.

In a preferred embodiment, the assay includes contacting the 21910, 56634, 55053, 2504, 15977, 14760, 25501, 17903, 3700, 21529, 26176, 26343, 56638, 18610, 33217, 21967, h1983, m1983, 38555 or 593 protein or biologically active portion thereof with a known compound which binds 21910, 56634, 55053, 2504, 15977, 14760, 25501, 17903, 3700, 21529, 26176, 26343, 56638, 18610, 33217, 21967, h1983, m1983, 38555 or 593 to form an assay mixture, contacting the assay mixture with a test compound, and determining the ability of the test compound to interact with a 21910, 56634, 55053, 2504, 15977, 14760, 25501, 17903, 3700, 21529, 26176, 26343, 56638, 18610, 33217, 21967, h1983, m1983, 38555 or 593 protein, wherein determining the ability of the test compound to interact with a 21910, 56634, 55053, 2504, 15977, 14760, 25501, 17903, 3700, 21529, 26176, 26343, 56638, 18610, 33217, 21967, h1983, m1983, 38555 or 593 protein includes determining the ability of the test compound to preferentially bind to 21910, 56634, 55053, 2504, 15977, 14760, 25501, 17903, 3700, 21529, 26176, 26343, 56638, 18610, 33217, 21967, h1983, m1983, 38555 or 593 or biologically active portion thereof, or to modulate the activity of a target molecule, as compared to the known compound.

The target gene products of the invention can, in vivo, interact with one or more cellular or extracellular macromolecules, such as proteins. For the purposes of this discussion, such cellular and extracellular macromolecules are referred to herein as "binding partners." Compounds that disrupt such interactions can be useful in regulating the activity of the target gene product. Such compounds can include, but are not limited to molecules such as antibodies, peptides, and small molecules. The preferred target genes/products for use in this embodiment are the 21910, 56634, 55053, 2504, 15977, 14760, 25501, 17903, 3700, 21529, 26176, 26343, 56638, 18610, 33217, 21967, h1983, m1983, 38555 or 593 genes herein identified. In an alternative embodiment, the invention provides methods for determining the ability of the test compound to modulate the activity of a 21910, 56634, 55053, 2504, 15977, 14760, 25501, 17903, 3700, 21529, 26176, 26343, 56638, 18610, 33217, 21967, h1983, m1983, 38555 or 593 protein through modulation of the activity of a downstream effector of a 21910, 56634, 55053, 2504, 15977, 14760, 25501, 17903, 3700, 21529, 26176, 26343, 56638, 18610, 33217, 21967, h1983, m1983, 38555 or 593 target molecule. For example, the activity of the effector molecule on an appropriate target can be determined, or the binding of the effector to an appropriate target can be determined, as previously described.

To identify compounds that interfere with the interaction between the target gene product and its cellular or extracellular binding partner(s), a reaction mixture containing the target gene product and the binding partner is prepared, under conditions and for a time sufficient, to allow the two products to form complex. In order to test an inhibitory agent, the reaction mixture is provided in the presence and absence of the test compound. The test compound can be initially included in the reaction mixture, or can be added at a time subsequent to the addition of the target gene and its cellular or extracellular binding partner. Control reaction mixtures are incubated without the test compound or with a placebo. The formation of any complexes between the target gene product and the cellular or extracellular binding partner is then detected. The formation of a complex in the control reaction, but not in the reaction mixture containing the test compound, indicates that the compound interferes with the interaction of the target gene product and the interactive binding partner.

Additionally, complex formation within reaction mixtures containing the test compound and normal target gene product can also be compared to complex formation within reaction mixtures containing the test compound and mutant target gene product. This comparison can be important in those cases wherein it is desirable to identify compounds that disrupt interactions of mutant but not normal target gene products.

These assays can be conducted in a heterogeneous or homogeneous format. Heterogeneous assays involve anchoring either the target gene product or the binding partner onto a solid phase, and detecting complexes anchored on the solid phase at the end of the reaction. In homogeneous assays, the entire reaction is carried out in a liquid phase. In either approach, the order of addition of reactants can be varied to obtain different information about the compounds being tested. For example, test compounds that interfere with the interaction between the target gene products and the binding partners, e.g., by competition, can be identified by conducting the reaction in the presence of the test substance. Alternatively, test compounds that disrupt preformed complexes, e.g., compounds with higher binding constants that displace one of the components from the complex, can be tested by adding the test compound to the reaction mixture after complexes have been formed. The various formats are briefly described below.

In a heterogeneous assay system, either the target gene product or the interactive cellular or extracellular binding partner, is anchored onto a solid surface (e.g., a microtiter plate), while the non-anchored species is labeled, either directly or indirectly. The anchored species can be immobilized by non-covalent or covalent attachments. Alternatively, an immobilized antibody specific or selective for the species to be anchored can be used to anchor the species to the solid surface.

In order to conduct the assay, the partner of the immobilized species is exposed to the coated surface with or without the test compound. After the reaction is complete, unreacted components are removed (e.g., by washing) and any complexes formed will remain immobilized on the solid surface. Where the non-immobilized species is pre-labeled, the detection of label immobilized on the surface indicates that complexes were formed. Where the non-immobilized species is not pre-labeled, an indirect label can be used to detect complexes anchored on the surface; e.g., using a labeled antibody specific or selective for the initially non-immobilized species (the antibody, in turn, can be directly labeled or indirectly labeled with, e.g., a labeled anti-Ig antibody). Depending upon the order of addition of reaction components, test compounds that inhibit complex formation or that disrupt preformed complexes can be detected.

Alternatively, the reaction can be conducted in a liquid phase in the presence or absence of the test compound, the reaction products separated from unreacted components, and complexes detected; e.g., using an immobilized antibody specific or selective for one of the binding components to anchor any complexes formed in solution, and a labeled antibody specific or selective for the other partner to detect anchored complexes. Again, depending upon the order of addition of reactants to the liquid phase, test compounds that inhibit complex or that disrupt preformed complexes can be identified.

In an alternate embodiment of the invention, a homogeneous assay can be used. For example, a preformed complex of the target gene product and the interactive cellular or extracellular binding partner product is prepared in that either the target gene products or their binding partners are labeled, but the signal generated by the label is quenched due to complex formation (see, e.g., U.S. Pat. No. 4,109,496 that utilizes this approach for immunoassays). The addition of a test substance that competes with and displaces one of the species from the preformed complex will result in the generation of a signal above background. In this way, test substances that disrupt target gene product-binding partner interaction can be identified.

In yet another aspect, the 21910, 56634, 55053, 2504, 15977, 14760, 25501, 17903, 3700, 21529, 26176, 26343, 56638, 18610, 33217, 21967, h1983, m1983, 38555 or 593 proteins can be used as "bait proteins" in a two-hybrid assay or three-hybrid assay (see, e.g., U.S. Pat. No. 5,283,317; Zervos et al. (1993) *Cell* 72:223-232; Madura et al. (1993) *J. Biol. Chem.* 268:12046-12054; Bartel et al. (1993) *Biotechniques* 14:920-924; Iwabuchi et al. (1993) *Oncogene* 8:1693-1696; and Brent WO94/10300), to identify other proteins, which bind to or interact with 21910, 56634, 55053, 2504, 15977, 14760, 25501, 17903, 3700, 21529, 26176, 26343, 56638, 18610, 33217, 21967, h1983, m1983, 38555 or 593 ("21910, 56634, 55053, 2504, 15977, 14760, 25501, 17903, 3700, 21529, 26176, 26343, 56638, 18610, 33217, 21967, h1983, m1983, 38555 or 593-binding proteins" or "21910, 56634, 55053, 2504, 15977, 14760, 25501, 17903, 3700, 21529, 26176, 26343, 56638, 18610, 33217, 21967, h1983, m1983, 38555 or 593-bp") and are involved in 21910, 56634, 55053, 2504, 15977, 14760, 25501, 17903, 3700, 21529, 26176, 26343, 56638, 18610, 33217, 21967, h1983, m1983, 38555 or 593 activity. Such 21910, 56634, 55053, 2504, 15977, 14760, 25501, 17903, 3700, 21529, 26176, 26343, 56638, 18610, 33217, 21967, h1983, m1983, 38555 or 593-bps can be activators or inhibitors of signals by the 21910, 56634, 55053, 2504, 15977, 14760, 25501, 17903, 3700, 21529, 26176, 26343, 56638, 18610, 33217, 21967, h1983, m1983, 38555 or 593 proteins or 21910, 56634, 55053, 2504, 15977, 14760, 25501, 17903, 3700, 21529, 26176, 26343, 56638, 18610, 33217, 21967, h1983, m1983, 38555 or 593 targets as, for example, downstream elements of a 21910, 56634, 55053, 2504, 15977, 14760, 25501, 17903, 3700, 21529, 26176, 26343, 56638, 18610, 33217, 21967, h1983, m1983, 38555 or 593-mediated signaling pathway.

The two-hybrid system is based on the modular nature of most transcription factors, which consist of separable DNA-binding and activation domains. Briefly, the assay utilizes two different DNA constructs. In one construct, the gene that codes for a 21910, 56634, 55053, 2504, 15977, 14760, 25501, 17903, 3700, 21529, 26176, 26343, 56638, 18610, 33217, 21967, h1983, m1983, 38555 or 593 protein is fused to a gene encoding the DNA binding domain of a known transcription factor (e.g., GAL-4). In the other construct, a DNA sequence, from a library of DNA sequences, that encodes an unidentified protein ("prey" or "sample") is fused to a gene that codes for the activation domain of the known transcription factor. (Alternatively the: 21910, 56634, 55053, 2504, 15977, 14760, 25501, 17903, 3700, 21529, 26176, 26343, 56638, 18610, 33217, 21967, h1983, m1983, 38555 or 593 protein can be the fused to the activator domain.) If the "bait" and the "prey" proteins are able to interact, in vivo, forming a 21910, 56634, 55053, 2504, 15977, 14760, 25501, 17903, 3700, 21529, 26176, 26343, 56638, 18610, 33217, 21967, h1983, m1983, 38555 or 593-dependent complex, the DNA-binding and activation domains of the transcription factor are brought into close proximity. This proximity allows transcription of a reporter gene (e.g., lacZ) which is operably linked to a transcriptional regulatory site responsive to the transcription factor. Expression of the reporter gene can be detected and cell colonies containing the functional transcription factor can be isolated and used to obtain the cloned gene which encodes the protein which interacts with the 21910, 56634, 55053, 2504, 15977, 14760, 25501, 17903, 3700, 21529, 26176, 26343, 56638, 18610, 33217, 21967, h1983, m1983, 38555 or 593 protein.

In another embodiment, modulators of 21910, 56634, 55053, 2504, 15977, 14760, 25501, 17903, 3700, 21529, 26176, 26343, 56638, 18610, 33217, 21967, h1983, m1983, 38555 or 593 expression are identified. For example, a cell or cell free mixture is contacted with a candidate compound and the expression of 21910, 56634, 55053, 2504, 15977, 14760, 25501, 17903, 3700, 21529, 26176, 26343, 56638, 18610, 33217, 21967, h1983, m1983, 38555 or 593 mRNA or protein evaluated relative to the level of expression of 21910, 56634, 55053, 2504, 15977, 14760, 25501, 17903, 3700, 21529, 26176, 26343, 56638, 18610, 33217, 21967, h1983, m1983, 38555 or 593 mRNA or protein in the absence of the candidate compound. When expression of 21910, 56634, 55053, 2504, 15977, 14760, 25501, 17903, 3700, 21529, 26176, 26343, 56638, 18610, 33217, 21967, h1983, m1983, 38555 or 593 mRNA or protein is greater in the presence of the candidate compound than in its absence, the candidate compound is identified as a stimulator of 21910, 56634, 55053, 2504, 15977, 14760, 25501, 17903, 3700, 21529, 26176, 26343, 56638, 18610, 33217, 21967, h1983, m1983, 38555 or 593 mRNA or protein expression. Alternatively, when expression of 21910, 56634, 55053, 2504, 15977, 14760, 25501, 17903, 3700, 21529, 26176, 26343, 56638, 18610, 33217, 21967, h1983, m1983, 38555 or 593 mRNA or protein is less (statistically significantly less) in the presence of the candidate compound than in its absence, the candidate compound is identified as an inhibitor of 21910, 56634, 55053, 2504, 15977, 14760, 25501, 17903, 3700, 21529, 26176, 26343, 56638, 18610, 33217, 21967, h1983, m1983, 38555 or 593 mRNA or protein expression. The level of 21910, 56634, 55053, 2504, 15977, 14760, 25501, 17903, 3700, 21529, 26176, 26343, 56638, 18610, 33217, 21967, h1983, m1983, 38555 or 593 mRNA or protein expression can be determined by methods described herein for detecting 21910, 56634, 55053, 2504, 15977, 14760, 25501, 17903, 3700, 21529, 26176, 26343, 56638, 18610, 33217, 21967, h1983, m1983, 38555 or 593 mRNA or protein.

In another aspect, the invention pertains to a combination of two or more of the assays described herein. For example, a modulating agent can be identified using a cell-based or a cell free assay, and the ability of the agent to modulate the activity of a 21910, 56634, 55053, 2504, 15977, 14760, 25501, 17903, 3700, 21529, 26176, 26343, 56638, 18610, 33217, 21967, h1983, m1983, 38555 or 593 protein can be confirmed in vivo, e.g., in an animal such as an animal model for aberrant or deficient guanylate kinase activity, phophatidylinositol 4-phosphate 5-kinase activity, kinase activity, transferase activity, aminopeptidase activity, adenylate cyclase activity, calpain protease activity, oxidoreductase activity, neprilysin protease activity, AMP binding enzyme activity and lysyl oxidase activity, or other activity.

This invention further pertains to novel agents identified by the above-described screening assays. Accordingly, it is within the scope of this invention to further use an agent identified as described herein (e.g., a 21910, 56634, 55053, 2504, 15977, 14760, 25501, 17903, 3700, 21529, 26176, 26343, 56638, 18610, 33217, 21967, h1983, m1983, 38555 or 593 modulating agent, an antisense 21910, 56634, 55053, 2504, 15977, 14760, 25501, 17903, 3700, 21529, 26176, 26343, 56638, 18610, 33217, 21967, h1983, m1983, 38555 or 593 nucleic acid molecule, a 21910, 56634, 55053, 2504, 15977, 14760, 25501, 17903, 3700, 21529, 26176, 26343, 56638, 18610, 33217, 21967, h1983, m1983, 38555 or 593-specific antibody, or a 21910, 56634, 55053, 2504, 15977, 14760, 25501, 17903, 3700, 21529, 26176, 26343, 56638, 18610, 33217, 21967, h1983, m1983, 38555 or 593-binding partner) in an appropriate animal model to determine the efficacy, toxicity, side effects, or mechanism of action, of treatment with such an agent. Furthermore, novel agents identified by the above-described screening assays can be used for treatments as described herein.

Detection Assays

Portions or fragments of the nucleic acid sequences identified herein can be used as polynucleotide reagents. For example, these sequences can be used to: (i) map their respective genes on a chromosome e.g., to locate gene regions associated with genetic disease or to associate 21910, 56634, 55053, 2504, 15977, 14760, 25501, 17903, 3700, 21529, 26176, 26343, 56638, 18610, 33217, 21967, h1983, m1983, 38555 or 593 with a disease; (ii) identify an individual from a minute biological sample (tissue typing); and (iii) aid in forensic identification of a biological sample. These applications are described in the subsections below.

Chromosome Mapping

The 21910, 56634, 55053, 2504, 15977, 14760, 25501, 17903, 3700, 21529, 26176, 26343, 56638, 18610, 33217, 21967, h1983, m1983, 38555 or 593 nucleotide sequences or portions thereof can be used to map the location of the 21910, 56634, 55053, 2504, 15977, 14760, 25501, 17903, 3700, 21529, 26176, 26343, 56638, 18610, 33217, 21967, h1983, m1983, 38555 or 593 genes on a chromosome. This process is called chromosome mapping. Chromosome mapping is useful in correlating the 21910, 56634, 55053, 2504, 15977, 14760, 25501, 17903, 3700, 21529, 26176, 26343, 56638, 18610, 33217, 21967, h1983, m1983, 38555 or 593 sequences with genes associated with disease.

Briefly, 21910, 56634, 55053, 2504, 15977, 14760, 25501, 17903, 3700, 21529, 26176, 26343, 56638, 18610, 33217, 21967, h1983, m1983, 38555 or 593 genes can be mapped to chromosomes by preparing PCR primers (preferably 15-25 bp in length) from the 21910, 56634, 55053, 2504, 15977, 14760, 25501, 17903, 3700, 21529, 26176, 26343, 56638, 18610, 33217, 21967, h1983, m1983, 38555 or 593 nucleotide sequences. These primers can then be used for PCR screening of somatic cell hybrids containing individual human chromosomes. Only those hybrids containing the human gene corresponding to the 21910, 56634, 55053, 2504, 15977, 14760, 25501, 17903, 3700, 21529, 26176, 26343, 56638, 18610, 33217, 21967, h1983, m1983, 38555 or 593 sequences will yield an amplified fragment.

A panel of somatic cell hybrids in which each cell line contains either a single human chromosome or a small number of human chromosomes, and a full set of mouse chromosomes, can allow easy mapping of individual genes to specific human chromosomes. (D'Eustachio et al. (1983) *Science* 220:919-924).

Other mapping strategies e.g., in situ hybridization (described in Fan et al. (1990) *Proc. Natl. Acad. Sci. USA*, 87:6223-27), pre-screening with labeled flow-sorted chromosomes, and pre-selection by hybridization to chromosome specific cDNA libraries can be used to map 21910, 56634, 55053, 2504, 15977, 14760, 25501, 17903, 3700, 21529, 26176, 26343, 56638, 18610, 33217, 21967, h1983, m1983, 38555 or 593 to a chromosomal location.

Fluorescence in situ hybridization (FISH) of a DNA sequence to a metaphase chromosomal spread can further be used to provide a precise chromosomal location in one step. The FISH technique can be used with a DNA sequence as short as 500 or 600 bases. However, clones larger than 1,000 bases have a higher likelihood of binding to a unique chromosomal location with sufficient signal intensity for simple detection. Preferably 1,000 bases, and more preferably 2,000 bases will suffice to get good results at a reasonable amount of time. For a review of this technique, see Verma et al. (1988) Human Chromosomes: A Manual of Basic Techniques, Pergamon Press, New York).

Reagents for chromosome mapping can be used individually to mark a single chromosome or a single site on that chromosome, or panels of reagents can be used for marking multiple sites and/or multiple chromosomes. Reagents corresponding to noncoding regions of the genes actually are preferred for mapping purposes. Coding sequences are more likely to be conserved within gene families, thus increasing the chance of cross hybridizations during chromosomal mapping.

Once a sequence has been mapped to a precise chromosomal location, the physical position of the sequence on the chromosome can be correlated with genetic map data. (Such data are found, for example, in McKusick, *Mendelian Inheritance in Man*, available on-line through Johns Hopkins University Welch Medical Library). The relationship between a gene and a disease, mapped to the same chromosomal region, can then be identified through linkage analysis (co-inheritance of physically adjacent genes), described in, for example, Egeland et al. (1987) *Nature,* 325:783-787.

Moreover, differences in the DNA sequences between individuals affected and unaffected with a disease associated with the 21910, 56634, 55053, 2504, 15977, 14760, 25501, 17903, 3700, 21529, 26176, 26343, 56638, 18610, 33217, 21967, h1983, m1983, 38555 or 593 gene, can be determined. If a mutation is observed in some or all of the affected individuals but not in any unaffected individuals, then the mutation is likely to be the causative agent of the particular disease. Comparison of affected and unaffected individuals generally involves first looking for structural alterations in the chromosomes, such as deletions or translocations that are visible from chromosome spreads or detectable using PCR based on that DNA sequence. Ultimately, complete sequencing of genes from several individuals can be performed to confirm the presence of a mutation and to distinguish mutations from polymorphisms.

Tissue Typing 21910, 56634, 55053, 2504, 15977, 14760, 25501, 17903, 3700, 21529, 26176, 26343, 56638, 18610, 33217, 21967, h1983, m1983, 38555 or 593 sequences can be used to identify individuals from biological samples using, e.g., restriction fragment length polymorphism (RFLP). In this technique, an individual's genomic DNA is digested with one or more restriction enzymes, the fragments separated, e.g., in a Southern blot, and probed to yield bands for identification. The sequences of the present invention are useful as additional DNA markers for RFLP (described in U.S. Pat. No. 5,272,057).

Furthermore, the sequences of the present invention can also be used to determine the actual base-by-base DNA sequence of selected portions of an individual's genome. Thus, the 21910, 56634, 55053, 2504, 15977, 14760, 25501, 17903, 3700, 21529, 26176, 26343, 56638, 18610, 33217, 21967, h1983, m1983, 38555 or 593 nucleotide sequences described herein can be used to prepare two PCR primers from the 5' and 3' ends of the sequences. These primers can then be used to amplify an individual's DNA and subsequently sequence it. Panels of corresponding DNA sequences from individuals, prepared in this manner, can provide unique individual identifications, as each individual will have a unique set of such DNA sequences due to allelic differences.

Allelic variation occurs to some degree in the coding regions of these sequences, and to a greater degree in the noncoding regions. Each of the sequences described herein can, to some degree, be used as a standard against which DNA from an individual can be compared for identification purposes. Because greater numbers of polymorphisms occur in the noncoding regions, fewer sequences are necessary to differentiate individuals. The noncoding sequences of SEQ ID NO:1, 5, 10, 18, 21, 24, 31, 39, 43, 46, 49, 54, 57, 63, 66, 71, 88, 104, 107 or 111 can provide positive individual identification with a panel of perhaps 10 to 1,000 primers which each yield a noncoding amplified sequence of 100 bases. If predicted coding sequences, such as those in SEQ ID NO:3, 7, 12, 20, 23, 26, 33, 41, 45, 48, 51, 56, 59, 65, 68, 73, 90, 106, 109 or 113 are used, a more appropriate number of primers for positive individual identification would be 500-2,000.

If a panel of reagents from 21910, 56634, 55053, 2504, 15977, 14760, 25501, 17903, 3700, 21529, 26176, 26343, 56638, 18610, 33217, 21967, h1983, m1983, 38555 or 593 nucleotide sequences described herein is used to generate a unique identification database for an individual, those same reagents can later be used to identify tissue from that individual. Using the unique identification database, positive identification of the individual, living or dead, can be made from extremely small tissue samples.

Use of Partial 21910, 56634, 55053, 2504, 15977, 14760, 25501, 17903, 3700, 21529, 26176, 26343, 56638, 18610, 33217, 21967, h1983, m1983, 38555 or 593 Sequences in Forensic Biology DNA-based identification techniques can also be used in forensic biology. To make such an identification, PCR technology can be used to amplify DNA sequences taken from very small biological samples such as tissues, e.g., hair or skin, or body fluids, e.g., blood, saliva, or semen found at a crime scene. The amplified sequence can then be compared to a standard, thereby allowing identification of the origin of the biological sample.

The sequences of the present invention can be used to provide polynucleotide reagents, e.g., PCR primers, targeted to specific loci in the human genome, which can enhance the reliability of DNA-based forensic identifications by, for example, providing another "identification marker" (i.e. another DNA sequence that is unique to a particular individual). As mentioned above, actual base sequence information can be used for identification as an accurate alternative to patterns formed by restriction enzyme generated fragments. Sequences targeted to noncoding regions of SEQ ID NO:1, 5, 10, 18, 21, 24, 31, 39, 43, 46, 49, 54, 57, 63, 66, 71, 88, 104, 107 or 111 (e.g., fragments derived from the noncoding regions of SEQ ID NO:1, 5, 10, 18, 21, 24, 31, 39, 43, 46, 49, 54, 57, 63, 66, 71, 88, 104, 107 or 111 having a length of at least 20 bases, preferably at least 30 bases) are particularly appropriate for this use.

The 21910, 56634, 55053, 2504, 15977, 14760, 25501, 17903, 3700, 21529, 26176, 26343, 56638, 18610, 33217, 21967, h1983, m1983, 38555 or 593 nucleotide sequences described herein can further be used to provide polynucleotide reagents, e.g., labeled or labelable probes which can be used in, for example, an in situ hybridization technique, to identify a specific tissue. This can be very useful in cases where a forensic pathologist is presented with a tissue of unknown origin. Panels of such 21910, 56634, 55053, 2504, 15977, 14760, 25501, 17903, 3700, 21529, 26176, 26343, 56638, 18610, 33217, 21967, h1983, m1983, 38555 or 593 probes can be used to identify tissue by species and/or by organ type.

In a similar fashion, these reagents, e.g., 21910, 56634, 55053, 2504, 15977, 14760, 25501, 17903, 3700, 21529, 26176, 26343, 56638, 18610, 33217, 21967, h1983, m1983, 38555 or 593 primers or probes can be used to screen tissue culture for contamination (i.e. screen for the presence of a mixture of different types of cells in a culture).

Predictive Medicine

The present invention also pertains to the field of predictive medicine in which diagnostic assays, prognostic assays, and monitoring clinical trials are used for prognostic (predictive) purposes to thereby treat an individual.

Generally, the invention provides, a method of determining if a subject is at risk for a disorder related to a lesion in or the misexpression of a gene which encodes 21910, 56634, 55053, 2504, 15977, 14760, 25501, 17903, 3700, 21529, 26176, 26343, 56638, 18610, 33217, 21967, h1983, m1983, 38555 or 593.

Such disorders include, e.g., a disorder associated with the misexpression of 21910, 56634, 55053, 2504, 15977, 14760, 25501, 17903, 3700, 21529, 26176, 26343, 56638, 18610, 33217, 21967, h1983, m1983, 38555 or 593 gene; cellular proliferative and/or differentiative disorders, brain disorders, platelet disorders, breast disorders, colon disorders, kidney (renal) disorders, lung disorders, ovarian disorders, prostate disorders, cervical disorders, spleen disorders, thymus disorders, thyroid disorders, testes disorders, hematopoeitic disorders, pancreatic disorders, skeletal muscle disorders, skin (dermal) disorders, disorders associated with bone metabolism, immune, e.g., inflammatory, disorders, cardiovascular disorders, endothelial cell disorders, liver disorders, viral diseases, pain disorders, metabolic disorders, neurological or CNS disorders, erythroid disorders, blood vessel disorders or angiogenic disorders.

The method includes one or more of the following: detecting, in a tissue of the subject, the presence or absence of a mutation which affects the expression of the 21910, 56634, 55053, 2504, 15977, 14760, 25501, 17903, 3700, 21529, 26176, 26343, 56638, 18610, 33217, 21967, h1983, m1983, 38555 or 593 gene, or detecting the presence or absence of a mutation in a region which controls the expression of the gene, e.g., a mutation in the 5' control region; detecting, in a tissue of the subject, the presence or absence of a mutation which alters the structure of the 21910, 56634, 55053, 2504, 15977, 14760, 25501, 17903, 3700, 21529, 26176, 26343, 56638, 18610, 33217, 21967, h1983, m1983, 38555 or 593 gene; detecting, in a tissue of the subject, the misexpression of the 21910, 56634, 55053, 2504, 15977, 14760, 25501, 17903, 3700, 21529, 26176, 26343, 56638, 18610, 33217, 21967, h1983, m1983, 38555 or 593 gene, at the mRNA level, e.g., detecting a non-wild type level of an mRNA; or detecting, in a tissue of the subject, the misexpression of the gene, at the protein level, e.g., detecting a non-wild type level of a 21910, 56634, 55053, 2504, 15977, 14760, 25501, 17903, 3700, 21529, 26176, 26343, 56638, 18610, 33217, 21967, h1983, m1983, 38555 or 593 polypeptide.

In preferred embodiments the method includes: ascertaining the existence of at least one of: a deletion of one or more nucleotides from the 21910, 56634, 55053, 2504, 15977, 14760, 25501, 17903, 3700, 21529, 26176, 26343, 56638, 18610, 33217, 21967, h1983, m1983, 38555 or 593 gene; an insertion of one or more nucleotides into the gene, a point mutation, e.g., a substitution of one or more nucleotides of the gene, a gross chromosomal rearrangement of the gene, e.g., a translocation, inversion, or deletion.

For example, detecting the genetic lesion can include: (i) providing a probe/primer including an oligonucleotide containing a region of nucleotide sequence which hybridizes to a sense or antisense sequence from SEQ ID NO:1, 5, 10, 18, 21, 24, 31, 39, 43, 46, 49, 54, 57, 63, 66, 71, 88, 104, 107 or 111, or naturally occurring mutants thereof or 5' or 3' flanking sequences naturally associated with the 21910, 56634, 55053, 2504, 15977, 14760, 25501, 17903, 3700, 21529, 26176, 26343, 56638, 18610, 33217, 21967, h1983, m1983, 38555 or 593 gene; (ii) exposing the probe/primer to nucleic acid of the tissue; and detecting, by hybridization, e.g., in situ hybridization, of the probe/primer to the nucleic acid, the presence or absence of the genetic lesion.

In preferred embodiments detecting the misexpression includes ascertaining the existence of at least one of: an alteration in the level of a messenger RNA transcript of the 21910, 56634, 55053, 2504, 15977, 14760, 25501, 17903, 3700, 21529, 26176, 26343, 56638, 18610, 33217, 21967, h1983, m1983, 38555 or 593 gene; the presence of a non-wild type splicing pattern of a messenger RNA transcript of the gene; or a non-wild type level of 21910, 56634, 55053, 2504, 15977, 14760, 25501, 17903, 3700, 21529, 26176, 26343, 56638, 18610, 33217, 21967, h1983, m1983, 38555 or 593.

Methods of the invention can be used prenatally or to determine if a subject's offspring will be at risk for a disorder.

In preferred embodiments the method includes determining the structure of a 21910, 56634, 55053, 2504, 15977, 14760, 25501, 17903, 3700, 21529, 26176, 26343, 56638, 18610, 33217, 21967, h1983, m1983, 38555 or 593 gene, an abnormal structure being indicative of risk for the disorder.

In preferred embodiments the method includes contacting a sample from the subject with an antibody to the 21910, 56634, 55053, 2504, 15977, 14760, 25501, 17903, 3700, 21529, 26176, 26343, 56638, 18610, 33217, 21967, h1983, m1983, 38555 or 593 protein or a nucleic acid, which hybridizes specifically with the gene. These and other embodiments are discussed below.

Diagnostic and Prognostic Assays

The presence, level, or absence of 21910, 56634, 55053, 2504, 15977, 14760, 25501, 17903, 3700, 21529, 26176, 26343, 56638, 18610, 33217, 21967, h1983, m1983, 38555 or 593 protein or nucleic acid in a biological sample can be evaluated by obtaining a biological sample from a test subject and contacting the biological sample with a compound or an agent capable of detecting 21910, 56634, 55053, 2504, 15977, 14760, 25501, 17903, 3700, 21529, 26176, 26343, 56638, 18610, 33217, 21967, h1983, m1983, 38555 or 593 protein or nucleic acid (e.g., mRNA, genomic DNA) that encodes 21910, 56634, 55053, 2504, 15977, 14760, 25501, 17903, 3700, 21529, 26176, 26343, 56638, 18610, 33217, 21967, h1983, m1983, 38555 or 593 protein such that the presence of 21910, 56634, 55053, 2504, 15977, 14760, 25501, 17903, 3700, 21529, 26176, 26343, 56638, 18610, 33217, 21967, h1983, m1983, 38555 or 593 protein or nucleic acid is detected in the biological sample. The term "biological sample" includes tissues, cells and biological fluids isolated from a subject, as well as tissues, cells and fluids present within a subject. A preferred biological sample is serum. The level of expression of the 21910, 56634, 55053, 2504, 15977, 14760, 25501, 17903, 3700, 21529, 26176, 26343, 56638, 18610, 33217, 21967, h1983, m1983, 38555 or 593 gene can be measured in a number of ways, including, but not limited to: measuring the mRNA encoded by the 21910, 56634, 55053, 2504, 15977, 14760, 25501, 17903, 3700, 21529, 26176, 26343, 56638, 18610, 33217, 21967, h1983, m1983, 38555 or 593 genes; measuring the amount of protein encoded by the 21910, 56634, 55053, 2504, 15977, 14760, 25501, 17903, 3700, 21529, 26176, 26343, 56638, 18610, 33217, 21967, h1983, m1983, 38555 or 593 genes; or measuring the activity of the protein encoded by the 21910, 56634, 55053, 2504, 15977, 14760, 25501, 17903, 3700, 21529, 26176, 26343, 56638, 18610, 33217, 21967, h1983, m1983, 38555 or 593 genes.

The level of mRNA corresponding to the 21910, 56634, 55053, 2504, 15977, 14760, 25501, 17903, 3700, 21529, 26176, 26343, 56638, 18610, 33217, 21967, h1983, m1983, 38555 or 593 gene in a cell can be determined both by in situ and by in vitro formats.

The isolated mRNA can be used in hybridization or amplification assays that include, but are not limited to, Southern or Northern analyses, polymerase chain reaction analyses and probe arrays. One preferred diagnostic method for the detection of mRNA levels involves contacting the isolated mRNA with a nucleic acid molecule (probe) that can hybridize to the mRNA encoded by the gene being detected. The nucleic acid probe can be, for example, a full-length 21910, 56634, 55053, 2504, 15977, 14760, 25501, 17903, 3700, 21529, 26176, 26343, 56638, 18610, 33217, 21967, h1983, m1983 or 593 nucleic acid, such as the nucleic acid of SEQ ID NO:1, 5, 10, 18, 21, 24, 31, 39, 43, 46, 49, 54, 57, 63, 66, 71, 88, 104, 107 or 111, or a portion thereof, such as an oligonucleotide of at least 7, 15, 30, 50, 100, 250 or 500 nucleotides in length and sufficient to specifically hybridize under stringent conditions to 21910, 56634, 55053, 2504, 15977, 14760, 25501, 17903, 3700, 21529, 26176, 26343, 56638, 18610, 33217, 21967, h1983, m1983, 38555 or 593 mRNA or genomic DNA. Other suitable probes for use in the diagnostic assays are described herein.

In one format, mRNA (or cDNA) is immobilized on a surface and contacted with the probes, for example by running the isolated mRNA on an agarose gel and transferring the mRNA from the gel to a membrane, such as nitrocellulose. In an alternative format, the probes are immobilized on a surface and the mRNA (or cDNA) is contacted with the probes, for example, in a two-dimensional gene chip array. A skilled artisan can adapt known mRNA detection methods for use in detecting the level of mRNA encoded by the 21910, 56634, 55053, 2504, 15977, 14760, 25501, 17903, 3700, 21529, 26176, 26343, 56638, 18610, 33217, 21967, h1983, m1983, 38555 or 593 genes.

The level of mRNA in a sample that is encoded by one of 21910, 56634, 55053, 2504, 15977, 14760, 25501, 17903, 3700, 21529, 26176, 26343, 56638, 18610, 33217, 21967, h1983, m1983, 38555 or 593 can be evaluated with nucleic acid amplification, e.g., by rtPCR (Mullis (1987) U.S. Pat. No. 4,683,202), ligase chain reaction (Barany (1991) *Proc. Natl. Acad. Sci. USA* 88:189-193), self sustained sequence replication (Guatelli et al., (1990) *Proc. Natl. Acad. Sci. USA* 87:1874-1878), transcriptional amplification system (Kwoh et al., (1989), *Proc. Natl. Acad. Sci. USA* 86:1173-1177), Q-Beta Replicase (Lizardi et al., (1988) *Bio/Technology* 6:1197), rolling circle replication (Lizardi et al., U.S. Pat. No. 5,854,033) or any other nucleic acid amplification method, followed by the detection of the amplified molecules using techniques known in the art. As used herein, amplification primers are defined as being a pair of nucleic acid molecules that can anneal to 5' or 3' regions of a gene (plus and minus strands, respectively, or vice-versa) and contain a short region in between. In general, amplification primers are from about 10 to 30 nucleotides in length and flank a region from about 50 to 200 nucleotides in length. Under appropriate conditions and with appropriate reagents, such primers permit the amplification of a nucleic acid molecule comprising the nucleotide sequence flanked by the primers.

For in situ methods, a cell or tissue sample can be prepared/processed and immobilized on a support, typically a glass slide, and then contacted with a probe that can hybridize to mRNA that encodes the 21910, 56634, 55053, 2504, 15977, 14760, 25501, 17903, 3700, 21529, 26176, 26343, 56638, 18610, 33217, 21967, h1983, m1983, 38555 or 593 gene being analyzed.

In another embodiment, the methods further contacting a control sample with a compound or agent capable of detecting 21910, 56634, 55053, 2504, 15977, 14760, 25501, 17903, 3700, 21529, 26176, 26343, 56638, 18610, 33217, 21967, h1983, m1983, 38555 or 593 mRNA, or genomic DNA, and comparing the presence of 21910, 56634, 55053, 2504, 15977, 14760, 25501, 17903, 3700, 21529, 26176, 26343, 56638, 18610, 33217, 21967, h1983, m1983, 38555 or 593 mRNA or genomic DNA in the control sample with the presence of 21910, 56634, 55053, 2504, 15977, 14760, 25501, 17903, 3700, 21529, 26176, 26343, 56638, 18610, 33217, 21967, h1983, m1983, 38555 or 593 mRNA or genomic DNA in the test sample.

A variety of methods can be used to determine the level of protein encoded by 21910, 56634, 55053, 2504, 15977, 14760, 25501, 17903, 3700, 21529, 26176, 26343, 56638, 18610, 33217, 21967, h1983, m1983, 38555 or 593. In general, these methods include contacting an agent that selectively binds to the protein, such as an antibody with a sample, to evaluate the level of protein in the sample. In a preferred embodiment, the antibody bears a detectable label. Antibodies can be polyclonal, or more preferably, monoclonal. An intact antibody, or a fragment thereof (e.g., Fab or $F(ab')_2$) can be used. The term "labeled", with regard to the probe or antibody, is intended to encompass direct labeling of the probe or antibody by coupling (i.e., physically linking) a detectable substance to the probe or antibody, as well as indirect labeling of the probe or antibody by reactivity with a detectable substance. Examples of detectable substances are provided herein.

The detection methods can be used to detect 21910, 56634, 55053, 2504, 15977, 14760, 25501, 17903, 3700, 21529, 26176, 26343, 56638, 18610, 33217, 21967, h1983, m1983, 38555 or 593 protein in a biological sample in vitro as well as in vivo. In vitro techniques for detection of 21910, 56634, 55053, 2504, 15977, 14760, 25501, 17903, 3700, 21529, 26176, 26343, 56638, 18610, 33217, 21967, h1983, m1983, 38555 or 593 protein include enzyme linked immunosorbent assays (ELISAs), immunoprecipitations, immunofluorescence, enzyme immunoassay (EIA), radioimmunoassay (RIA), and Western blot analysis. In vivo techniques for detection of 21910, 56634, 55053, 2504, 15977, 14760, 25501, 17903, 3700, 21529, 26176, 26343, 56638, 18610, 33217, 21967, h1983, m1983, 38555 or 593 protein include introducing into a subject a labeled anti-21910, 56634, 55053, 2504, 15977, 14760, 25501, 17903, 3700, 21529, 26176, 26343, 56638, 18610, 33217, 21967, h1983, m1983, 38555 or 593 antibody. For example, the antibody can be labeled with a radioactive marker whose presence and location in a subject can be detected by standard imaging techniques.

In another embodiment, the methods further include contacting the control sample with a compound or agent capable of detecting 21910, 56634, 55053, 2504, 15977, 14760, 25501, 17903, 3700, 21529, 26176, 26343, 56638, 18610, 33217, 21967, h1983, m1983, 38555 or 593 protein, and comparing the presence of 21910, 56634, 55053, 2504, 15977, 14760, 25501, 17903, 3700, 21529, 26176, 26343, 56638, 18610, 33217, 21967, h1983, m1983, 38555 or 593 protein in the control sample with the presence of 21910, 56634, 55053, 2504, 15977, 14760, 25501, 17903, 3700, 21529, 26176, 26343, 56638, 18610, 33217, 21967, h1983, m1983, 38555 or 593 protein in the test sample.

The invention also includes kits for detecting the presence of 21910, 56634, 55053, 2504, 15977, 14760, 25501, 17903, 3700, 21529, 26176, 26343, 56638, 18610, 33217, 21967, h1983, m1983, 38555 or 593 in a biological sample. For example, the kit can include a compound or agent capable of detecting 21910, 56634, 55053, 2504, 15977, 14760, 25501, 17903, 3700, 21529, 26176, 26343, 56638, 18610, 33217, 21967, h1983, m1983, 38555 or 593 protein or mRNA in a biological sample; and a standard. The compound or agent can be packaged in a suitable container. The kit can further comprise instructions for using the kit to detect 21910, 56634, 55053, 2504, 15977, 14760, 25501, 17903, 3700, 21529, 26176, 26343, 56638, 18610, 33217, 21967, h1983, m1983, 38555 or 593 protein or nucleic acid.

For antibody-based kits, the kit can include: (1) a first antibody (e.g., attached to a solid support) which binds to a polypeptide corresponding to a marker of the invention; and, optionally, (2) a second, different antibody which binds to either the polypeptide or the first antibody and is conjugated to a detectable agent.

For oligonucleotide-based kits, the kit can include: (1) an oligonucleotide, e.g., a detectably labeled oligonucleotide, which hybridizes to a nucleic acid sequence encoding a polypeptide corresponding to a marker of the invention or (2) a pair of primers useful for amplifying a nucleic acid molecule corresponding to a marker of the invention. The kit can also includes a buffering agent, a preservative, or a protein stabilizing agent. The kit can also includes components necessary for detecting the detectable agent (e.g., an enzyme or a substrate). The kit can also contain a control sample or a series of control samples which can be assayed and compared to the test sample contained. Each component of the kit can be enclosed within an individual container and all of the various containers can be within a single package, along with instructions for interpreting the results of the assays performed using the kit.

The diagnostic methods described herein can identify subjects having, or at risk of developing, a disease or disorder associated with misexpressed or aberrant or unwanted 21910, 56634, 55053, 2504, 15977, 14760, 25501, 17903, 3700, 21529, 26176, 26343, 56638, 18610, 33217, 21967, h1983, m1983, 38555 or 593 expression or activity. As used herein, the term "unwanted" includes an unwanted phenomenon involved in a biological response such as pain or deregulated cell proliferation.

In one embodiment, a disease or disorder associated with aberrant or unwanted 21910, 56634, 55053, 2504, 15977, 14760, 25501, 17903, 3700, 21529, 26176, 26343, 56638, 18610, 33217, 21967, h1983, m1983, 38555 or 593 expression or activity is identified. A test sample is obtained from a subject and 21910, 56634, 55053, 2504, 15977, 14760, 25501, 17903, 3700, 21529, 26176, 26343, 56638, 18610, 33217, 21967, h1983, m1983, 38555 or 593 protein or nucleic acid (e.g., mRNA or genomic DNA) is evaluated, wherein the level, e.g., the presence or absence, of 21910, 56634, 55053, 2504, 15977, 14760, 25501, 17903, 3700, 21529, 26176, 26343, 56638, 18610, 33217, 21967, h1983, m1983, 38555 or 593 protein or nucleic acid is diagnostic for a subject having or at risk of developing a disease or disorder associated with aberrant or unwanted 21910, 56634, 55053, 2504, 15977, 14760, 25501, 17903, 3700, 21529, 26176, 26343, 56638, 18610, 33217, 21967, h1983, m1983, 38555 or 593 expression or activity. As used herein, a "test sample" refers to a biological sample obtained from a subject of interest, including a biological fluid (e.g., serum), cell sample, or tissue.

The prognostic assays described herein can be used to determine whether a subject can be administered an agent (e.g., an agonist, antagonist, peptidomimetic, protein, peptide, nucleic acid, small molecule, or other drug candidate) to treat a disease or disorder associated with aberrant or unwanted 21910, 56634, 55053, 2504, 15977, 14760, 25501, 17903, 3700, 21529, 26176, 26343, 56638, 18610, 33217, 21967, h1983, m1983, 38555 or 593 expression or activity. For example, such methods can be used to determine whether a subject can be effectively treated with an agent for a cellular proliferative and/or differentiative disorder, brain disorder, platelet disorder, breast disorder, colon disorder, kidney (renal) disorder, lung disorder, ovarian disorder, prostate disorder, cervical disorder, spleen disorder, thymus disorder, thyroid disorder, testes disorder, hematopoeitic disorder, pancreatic disorder, skeletal muscle disorder, skin (dermal) disorder, disorder associated with bone metabolism, immune, e.g., inflammatory, disorder, cardiovascular disorder, endothelial cell disorder, liver disorder, viral disease, pain disorder, metabolic disorder, neurological or CNS disorder, erythroid disorder, blood vessel disorder or angiogenic disorder.

The methods of the invention can also be used to detect genetic alterations in a 21910, 56634, 55053, 2504, 15977, 14760, 25501, 17903, 3700, 21529, 26176, 26343, 56638, 18610, 33217, 21967, h1983, m1983, 38555 or 593 gene, thereby determining if a subject with the altered gene is at risk for a disorder characterized by misregulation in 21910, 56634, 55053, 2504, 15977, 14760, 25501, 17903, 3700, 21529, 26176, 26343, 56638, 18610, 33217, 21967, h1983, m1983, 38555 or 593 protein activity or nucleic acid expression, such as a cellular proliferative and/or differentiative disorder, brain disorder, platelet disorder, breast disorder, colon disorder, kidney (renal) disorder, lung disorder, ovarian disorder, prostate disorder, cervical disorder, spleen disorder, thymus disorder, thyroid disorder, testes disorder, hematopoeitic disorder, pancreatic disorder, skeletal muscle disorder, skin (dermal) disorder, disorder associated with bone metabolism, immune, e.g., inflammatory, disorder, cardiovascular disorder, endothelial cell disorder, liver disorder, viral disease, pain disorder, metabolic disorder, neurological or CNS disorder, erythroid disorder, blood vessel disorder or angiogenic disorder. In preferred embodiments, the methods include detecting, in a sample from the subject, the presence or absence of a genetic alteration characterized by at least one of an alteration affecting the integrity of a gene encoding a 21910, 56634, 55053, 2504, 15977, 14760, 25501, 17903, 3700, 21529, 26176, 26343, 56638, 18610, 33217, 21967, h1983, m1983, 38555 or 593-protein, or the mis-expression of the 21910, 56634, 55053, 2504, 15977, 14760, 25501, 17903, 3700, 21529, 26176, 26343, 56638, 18610, 33217, 21967, h1983, m1983, 38555 or 593 gene. For example, such genetic alterations can be detected by ascertaining the existence of at least one of 1) a deletion of one or more nucleotides from a 21910, 56634, 55053, 2504, 15977, 14760, 25501, 17903, 3700, 21529, 26176, 26343, 56638, 18610, 33217, 21967, h1983, m1983, 38555 or 593 gene; 2) an addition of one or more nucleotides to a 21910, 56634, 55053, 2504, 15977, 14760, 25501, 17903, 3700, 21529, 26176, 26343, 56638, 18610, 33217, 21967, h1983, m1983, 38555 or 593 gene; 3) a substitution of one or more nucleotides of a 21910, 56634, 55053, 2504, 15977, 14760, 25501, 17903, 3700, 21529, 26176, 26343, 56638, 18610, 33217, 21967, h1983, m1983, 38555 or 593 gene, 4) a chromosomal rearrangement of a 21910, 56634, 55053, 2504, 15977, 14760, 25501, 17903, 3700, 21529, 26176, 26343, 56638, 18610, 33217, 21967, h1983, m1983, 38555 or 593 gene; 5) an alteration in the level of a messenger RNA transcript of a 21910, 56634, 55053, 2504, 15977, 14760, 25501, 17903, 3700, 21529, 26176, 26343, 56638, 18610, 33217, 21967, h1983, m1983, 38555 or 593 gene, 6) aberrant modification of a 21910, 56634, 55053, 2504, 15977, 14760, 25501, 17903, 3700, 21529, 26176, 26343, 56638, 18610, 33217, 21967, h1983, m1983, 38555 or 593 gene, such as of the methylation pattern of the genomic DNA, 7) the presence of a non-wild type splicing pattern of a messenger RNA transcript of a 21910, 56634, 55053, 2504, 15977, 14760, 25501, 17903, 3700, 21529, 26176, 26343, 56638, 18610, 33217, 21967, h1983, m1983, 38555 or 593 gene, 8) a non-wild type level of a 21910, 56634, 55053, 2504, 15977, 14760, 25501, 17903, 3700, 21529, 26176, 26343, 56638, 18610, 33217, 21967, h1983, m1983, 38555 or 593-protein, 9) allelic loss of a 21910, 56634, 55053, 2504, 15977, 14760, 25501, 17903, 3700, 21529, 26176, 26343, 56638, 18610, 33217, 21967, h1983, m1983, 38555 or 593 gene, and 10) inappropriate post-translational modification of a 21910, 56634, 55053, 2504, 15977, 14760, 25501, 17903, 3700, 21529, 26176, 26343, 56638, 18610, 33217, 21967, h1983, m1983, 38555 or 593-protein.

An alteration can be detected without a probe/primer in a polymerase chain reaction, such as anchor PCR or RACE PCR, or, alternatively, in a ligation chain reaction (LCR), the latter of which can be particularly useful for detecting point mutations in the 21910, 56634, 55053, 2504, 15977, 14760, 25501, 17903, 3700, 21529, 26176, 26343, 56638, 18610, 33217, 21967, h1983, m1983, 38555 or 593-gene. This method can include the steps of collecting a sample of cells from a subject, isolating nucleic acid (e.g., genomic, mRNA or both) from the sample, contacting the nucleic acid sample with one or more primers which specifically hybridize to a 21910, 56634, 55053, 2504, 15977, 14760, 25501, 17903, 3700, 21529, 26176, 26343, 56638, 18610, 33217, 21967, h1983, m1983, 38555 or 593 gene under conditions such that hybridization and amplification of the 21910, 56634, 55053, 2504, 15977, 14760, 25501, 17903, 3700, 21529, 26176, 26343, 56638, 18610, 33217, 21967, h1983, m1983, 38555 or 593 gene (if present) occurs, and detecting the presence or absence of an amplification product, or detecting the size of the amplification product and comparing the length to a control sample. It is anticipated that PCR and/or LCR may be desirable to use as a preliminary amplification step in conjunction with any of the techniques used for detecting mutations described herein. Alternatively, other amplification methods described herein or known in the art can be used.

In another embodiment, mutations in a 21910, 56634, 55053, 2504, 15977, 14760, 25501, 17903, 3700, 21529, 26176, 26343, 56638, 18610, 33217, 21967, h1983, m1983, 38555 or 593 gene from a sample cell can be identified by detecting alterations in restriction enzyme cleavage patterns. For example, sample and control DNA is isolated, amplified (optionally), digested with one or more restriction endonucleases, and fragment length sizes are determined, e.g., by gel electrophoresis and compared. Differences in fragment length sizes between sample and control DNA indicates mutations in the sample DNA. Moreover, the use of sequence specific ribozymes (see, for example, U.S. Pat. No. 5,498,531) can be used to score for the presence of specific mutations by development or loss of a ribozyme cleavage site.

In other embodiments, genetic mutations in 21910, 56634, 55053, 2504, 15977, 14760, 25501, 17903, 3700, 21529, 26176, 26343, 56638, 18610, 33217, 21967, h1983, m1983, 38555 or 593 can be identified by hybridizing a sample and control nucleic acids, e.g., DNA or RNA, two dimensional arrays, e.g., chip based arrays. Such arrays include a plurality of addresses, each of which is positionally distinguishable from the other. A different probe is located at each address of the plurality. The arrays can have a high density of addresses, e.g., can contain hundreds or thousands of oligonucleotides probes (Cronin et al. (1996) *Human Mutation* 7: 244-255; Kozal et al. (1996) *Nature Medicine* 2: 753-759). For example, genetic mutations in 21910, 56634, 55053, 2504, 15977, 14760, 25501, 17903, 3700, 21529, 26176, 26343, 56638, 18610, 33217, 21967, h1983, m1983, 38555 or 593 can be identified in two dimensional arrays containing light-generated DNA probes as described in Cronin, M. T. et al. supra. Briefly, a first hybridization array of probes can be used to scan through long stretches of DNA in a sample and control to identify base changes between the sequences by making linear arrays of sequential overlapping probes. This step allows the identification of point mutations. This step is followed by a second hybridization array that allows the characterization of specific mutations by using smaller, specialized probe arrays complementary to all variants or mutations detected. Each mutation array is composed of parallel probe sets, one complementary to the wild-type gene and the other complementary to the mutant gene.

In yet another embodiment, any of a variety of sequencing reactions known in the art can be used to directly sequence the 21910, 56634, 55053, 2504, 15977, 14760, 25501, 17903, 3700, 21529, 26176, 26343, 56638, 18610, 33217, 21967, h1983, m1983, 38555 or 593 gene and detect mutations by comparing the sequence of the sample 21910, 56634, 55053, 2504, 15977, 14760, 25501, 17903, 3700, 21529, 26176, 26343, 56638, 18610, 33217, 21967, h1983, m1983, 38555 or 593 with the corresponding wild-type (control) sequence. Automated sequencing procedures can be utilized when performing the diagnostic assays (Naeve et al. (1995) *Biotechniques* 19:448-53), including sequencing by mass spectrometry.

Other methods for detecting mutations in the 21910, 56634, 55053, 2504, 15977, 14760, 25501, 17903, 3700, 21529, 26176, 26343, 56638, 18610, 33217, 21967, h1983, m1983, 38555 or 593 gene include methods in which protection from cleavage agents is used to detect mismatched bases in RNA/RNA or RNA/DNA heteroduplexes (Myers et al. (1985) *Science* 230:1242; Cotton et al. (1988) *Proc. Natl. Acad Sci USA* 85:4397; Saleeba et al. (1992) *Methods Enzymol.* 217:286-295).

In still another embodiment, the mismatch cleavage reaction employs one or more proteins that recognize mismatched base pairs in double-stranded DNA (so called "DNA mismatch repair" enzymes) in defined systems for detecting and mapping point mutations in 21910, 56634, 55053, 2504, 15977, 14760, 25501, 17903, 3700, 21529, 26176, 26343, 56638, 18610, 33217, 21967, h1983, m1983, 38555 or 593 cDNAs obtained from samples of cells. For example, the mutY enzyme of *E. coli* cleaves A at G/A mismatches and the thymidine DNA glycosylase from HeLa cells cleaves T at G/T mismatches (Hsu et al. (1994) *Carcinogenesis* 15:1657-1662; U.S. Pat. No. 5,459,039).

In other embodiments, alterations in electrophoretic mobility will be used to identify mutations in 21910, 56634, 55053, 2504, 15977, 14760, 25501, 17903, 3700, 21529, 26176, 26343, 56638, 18610, 33217, 21967, h1983, m1983, 38555 or 593 genes. For example, single strand conformation polymorphism (SSCP) can be used to detect differences in electrophoretic mobility between mutant and wild type nucleic acids (Orita et al. (1989) *Proc Natl. Acad. Sci USA:* 86:2766, see also Cotton (1993) *Mutat. Res.* 285:125-144; and Hayashi (1992) *Genet. Anal. Tech. Appl.* 9:73-79). Single-stranded DNA fragments of sample and control 21910, 56634, 55053, 2504, 15977, 14760, 25501, 17903, 3700, 21529, 26176, 26343, 56638, 18610, 33217, 21967, h1983, m1983, 38555 or 593 nucleic acids will be denatured and allowed to renature. The secondary structure of single-stranded nucleic acids varies according to sequence, the resulting alteration in electrophoretic mobility enables the detection of even a single base change. The DNA fragments can be labeled or detected with labeled probes. The sensitivity of the assay can be enhanced by using RNA (rather than DNA), in which the secondary structure is more sensitive to a change in sequence. In a preferred embodiment, the subject method utilizes heteroduplex analysis to separate double stranded heteroduplex molecules on the basis of changes in electrophoretic mobility (Keen et al. (1991) *Trends Genet* 7:5).

In yet another embodiment, the movement of mutant or wild-type fragments in polyacrylamide gels containing a gradient of denaturant is assayed using denaturing gradient gel electrophoresis (DGGE) (Myers et al. (1985) *Nature* 313: 495). When DGGE is used as the method of analysis, DNA will be modified to insure that it does not completely denature, for example by adding a GC clamp of approximately 40 bp of high-melting GC-rich DNA by PCR. In a further embodiment, a temperature gradient is used in place of a denaturing gradient to identify differences in the mobility of control and sample DNA (Rosenbaum and Reissner (1987) *Biophys Chem* 265:12753).

Examples of other techniques for detecting point mutations include, but are not limited to, selective oligonucleotide hybridization, selective amplification, or selective primer extension (Saiki et al. (1986) *Nature* 324:163); Saiki et al. (1989) *Proc. Natl. Acad. Sci USA* 86:6230).

Alternatively, allele specific amplification technology which depends on selective PCR amplification can be used in conjunction with the instant invention. Oligonucleotides used as primers for specific amplification can carry the mutation of interest in the center of the molecule (so that amplification depends on differential hybridization) (Gibbs et al. (1989) *Nucleic Acids Res.* 17:2437-2448) or at the extreme 3' end of one primer where, under appropriate conditions, mismatch can prevent, or reduce polymerase extension (Prossner (1993) *Tibtech* 11:238). In addition it may be desirable to introduce a novel restriction site in the region of the mutation to create cleavage-based detection (Gasparini et al. (1992) *Mol. Cell Probes* 6: 1). It is anticipated that in certain embodiments amplification can also be performed using Taq ligase for amplification (Barany (1991) *Proc. Natl. Acad. Sci USA* 88:189-93). In such cases, ligation will occur only if there is a perfect match at the 3' end of the 5' sequence making it possible to detect the presence of a known mutation at a specific site by looking for the presence or absence of amplification.

The methods described herein can be performed, for example, by utilizing pre-packaged diagnostic kits comprising at least one probe nucleic acid or antibody reagent described herein, which can be conveniently used, e.g., in clinical settings to diagnose patients exhibiting symptoms or family history of a disease or illness involving a 21910, 56634, 55053, 2504, 15977, 14760, 25501, 17903, 3700, 21529, 26176, 26343, 56638, 18610, 33217, 21967, h1983, m1983, 38555 or 593 gene.

Use of 21910, 56634, 55053, 2504, 15977, 14760, 25501, 17903, 3700, 21529, 26176, 26343, 56638, 18610, 33217, 21967, h1983, m1983, 38555 or 593 Molecules as Surrogate Markers The 21910, 56634, 55053, 2504, 15977, 14760, 25501, 17903, 3700, 21529, 26176, 26343, 56638, 18610, 33217, 21967, h1983, m1983, 38555 or 593 molecules of the invention are also useful as markers of disorders or disease states, as markers for precursors of disease states, as markers for predisposition of disease states, as markers of drug activity, or as markers of the pharmacogenomic profile of a subject. Using the methods described herein, the presence, absence and/or quantity of the 21910, 56634, 55053, 2504, 15977, 14760, 25501, 17903, 3700, 21529, 26176, 26343, 56638, 18610, 33217, 21967, h1983, m1983, 38555 or 593 molecules of the invention can be detected, and can be correlated with one or more biological states in vivo. For example, the 21910, 56634, 55053, 2504, 15977, 14760, 25501, 17903, 3700, 21529, 26176, 26343, 56638, 18610, 33217, 21967, h1983, m1983, 38555 or 593 molecules of the invention can serve as surrogate markers for one or more disorders or disease states or for conditions leading up to disease states. As used herein, a "surrogate marker" is an objective biochemical marker which correlates with the absence or presence of a disease or disorder, or with the progression of a disease or disorder (e.g., with the presence or absence of a tumor). The presence or quantity of such markers is independent of the disease. Therefore, these markers can serve to indicate whether a particular course of treatment is effective in lessening a disease state or disorder. Surrogate markers are of particular use when the presence or extent of a disease state or disorder is difficult to assess through standard methodologies (e.g., early stage tumors), or when an assessment of disease progression is desired before a potentially dangerous clinical endpoint is reached (e.g., an assessment of cardiovascular disease can be made using cholesterol levels as a surrogate marker, and an analysis of HIV infection can be made using HIV RNA levels as a surrogate marker, well in advance of the undesirable clinical outcomes of myocardial infarction or fully-developed AIDS). Examples of the use of surrogate markers in the art include: Koomen et al. (2000) *J. Mass. Spectrom.* 35: 258-264; and James (1994) *AIDS Treatment News Archive* 209.

The 21910, 56634, 55053, 2504, 15977, 14760, 25501, 17903, 3700, 21529, 26176, 26343, 56638, 18610, 33217, 21967, h1983, m1983, 38555 or 593 molecules of the invention are also useful as pharmacodynamic markers. As used herein, a "pharmacodynamic marker" is an objective biochemical marker which correlates specifically with drug effects. The presence or quantity of a pharmacodynamic marker is not related to the disease state or disorder for which the drug is being administered; therefore, the presence or quantity of the marker is indicative of the presence or activity of the drug in a subject. For example, a pharmacodynamic marker can be indicative of the concentration of the drug in a biological tissue, in that the marker is either expressed or transcribed or not expressed or transcribed in that tissue in relationship to the level of the drug. In this fashion, the distribution or uptake of the drug can be monitored by the pharmacodynamic marker. Similarly, the presence or quantity of the pharmacodynamic marker can be related to the presence or quantity of the metabolic product of a drug, such that the presence or quantity of the marker is indicative of the relative breakdown rate of the drug in vivo. Pharmacodynamic markers are of particular use in increasing the sensitivity of detection of drug effects, particularly when the drug is administered in low doses. Since even a small amount of a drug can be sufficient to activate multiple rounds of marker (e.g., a 21910, 56634, 55053, 2504, 15977, 14760, 25501, 17903, 3700, 21529, 26176, 26343, 56638, 18610, 33217, 21967, h1983, m1983, 38555 or 593 marker) transcription or expression, the amplified marker can be in a quantity which is more readily detectable than the drug itself. Also, the marker can be more easily detected due to the nature of the marker itself; for example, using the methods described herein, anti-21910, 56634, 55053, 2504, 15977, 14760, 25501, 17903, 3700, 21529, 26176, 26343, 56638, 18610, 33217, 21967, h1983, m1983, 38555 or 593 antibodies can be employed in an immune-based detection system for a 21910, 56634, 55053, 2504, 15977, 14760, 25501, 17903, 3700, 21529, 26176, 26343, 56638, 18610, 33217, 21967, h1983, m1983, 38555 or 593 protein marker, or 21910, 56634, 55053, 2504, 15977, 14760, 25501, 17903, 3700, 21529, 26176, 26343, 56638, 18610, 33217, 21967, h1983, m1983, 38555 or 593-specific radiolabeled probes can be used to detect a 21910, 56634, 55053, 2504, 15977, 14760, 25501, 17903, 3700, 21529, 26176, 26343, 56638, 18610, 33217, 21967, h1983, m1983, 38555 or 593 mRNA marker. Furthermore, the use of a pharmacodynamic marker can offer mechanism-based prediction of risk due to drug treatment beyond the range of possible direct observations. Examples of the use of pharmacodynamic markers in the art include: Matsuda et al. U.S. Pat. No. 6,033,862; Hattis et al. (1991) *Env. Health Perspect.* 90: 229-238; Schentag (1999) *Am. J. Health-Syst. Pharm.* 56 Suppl. 3: S21-S24; and Nicolau (1999) *Am. J. Health-Syst. Pharm.* 56 Suppl. 3: S16-S20.

The 21910, 56634, 55053, 2504, 15977, 14760, 25501, 17903, 3700, 21529, 26176, 26343, 56638, 18610, 33217, 21967, h1983, m1983, 38555 or 593 molecules of the invention are also useful as pharmacogenomic markers. As used herein, a "pharmacogenomic marker" is an objective biochemical marker which correlates with a specific clinical drug response or susceptibility in a subject (see, e.g., McLeod et al. (1999) *Eur. J. Cancer* 35:1650-1652). The presence or quantity of the pharmacogenomic marker is related to the predicted response of the subject to a specific drug or class of drugs prior to administration of the drug. By assessing the presence or quantity of one or more pharmacogenomic markers in a subject, a drug therapy which is most appropriate for the subject, or which is predicted to have a greater degree of success, can be selected. For example, based on the presence or quantity of RNA, or protein (e.g., 21910, 56634, 55053, 2504, 15977, 14760, 25501, 17903, 3700, 21529, 26176, 26343, 56638, 18610, 33217, 21967, h1983, m1983, 38555 or 593 protein or RNA) for specific tumor markers in a subject, a drug or course of treatment can be selected that is optimized for the treatment of the specific tumor likely to be present in the subject. Similarly, the presence or absence of a specific sequence mutation in 21910, 56634, 55053, 2504, 15977, 14760, 25501, 17903, 3700, 21529, 26176, 26343, 56638, 18610, 33217, 21967, h1983, m1983, 38555 or 593 DNA can correlate with a 21910, 56634, 55053, 2504, 15977, 14760, 25501, 17903, 3700, 21529, 26176, 26343, 56638, 18610, 33217, 21967, h1983, m1983, 38555 or 593 drug response. The use of pharmacogenomic markers therefore permits the application of the most appropriate treatment for each subject without having to administer the therapy.

Pharmaceutical Compositions

The nucleic acid and polypeptides, fragments thereof, as well as anti-21910, 56634, 55053, 2504, 15977, 14760, 25501, 17903, 3700, 21529, 26176, 26343, 56638, 18610, 33217, 21967, h1983, m1983, 38555 or 593 antibodies (also referred to herein as "active compounds") of the invention can be incorporated into pharmaceutical compositions. Such compositions typically include the nucleic acid molecule, protein, or antibody and a pharmaceutically acceptable carrier. As used herein the language "pharmaceutically acceptable carrier" includes solvents, dispersion media, coatings, antibacterial and antifungal agents, isotonic and absorption delaying agents, and the like, compatible with pharmaceutical administration. Supplementary active compounds can also be incorporated into the compositions.

A pharmaceutical composition is formulated to be compatible with its intended route of administration. Examples of routes of administration include parenteral, e.g., intravenous, intradermal, subcutaneous, oral (e.g., inhalation), transdermal (topical), transmucosal, and rectal administration. Solutions or suspensions used for parenteral, intradermal, or subcutaneous application can include the following components: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfite; chelating agents such as ethylenediaminetetraacetic acid; buffers such as acetates, citrates or phosphates and agents for the adjustment of tonicity such as sodium chloride or dextrose. pH can be adjusted with acids or bases, such as hydrochloric acid or sodium hydroxide. The parenteral preparation can be enclosed in ampoules, disposable syringes or multiple dose vials made of glass or plastic.

Pharmaceutical compositions suitable for injectable use include sterile aqueous solutions (where water soluble) or dispersions and sterile powders for the extemporaneous preparation of sterile injectable solutions or dispersion. For intravenous administration, suitable carriers include physiological saline, bacteriostatic water, Cremophor EL™ (BASF, Parsippany, N.J.) or phosphate buffered saline (PBS). In all cases, the composition must be sterile and should be fluid to the extent that easy syringability exists. It should be stable under the conditions of manufacture and storage and must be preserved against the contaminating action of microorganisms such as bacteria and fungi. The carrier can be a solvent or dispersion medium containing, for example, water, ethanol, polyol (for example, glycerol, propylene glycol, and liquid polyetheylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In many cases, it will be preferable to include isotonic agents, for example, sugars, polyalcohols such as manitol, sorbitol, sodium chloride in the composition. Prolonged absorption of the injectable compositions can be brought about by including in the composition an agent which delays absorption, for example, aluminum monostearate and gelatin.

Sterile injectable solutions can be prepared by incorporating the active compound in the required amount in an appropriate solvent with one or a combination of ingredients enumerated above, as required, followed by filtered sterilization. Generally, dispersions are prepared by incorporating the active compound into a sterile vehicle which contains a basic dispersion medium and the required other ingredients from those enumerated above. In the case of sterile powders for the preparation of sterile injectable solutions, the preferred methods of preparation are vacuum drying and freeze-drying which yields a powder of the active ingredient plus any additional desired ingredient from a previously sterile-filtered solution thereof.

Oral compositions generally include an inert diluent or an edible carrier. For the purpose of oral therapeutic administration, the active compound can be incorporated with excipients and used in the form of tablets, troches, or capsules, e.g., gelatin capsules. Oral compositions can also be prepared using a fluid carrier for use as a mouthwash. Pharmaceutically compatible binding agents, and/or adjuvant materials can be included as part of the composition. The tablets, pills, capsules, troches and the like can contain any of the following ingredients, or compounds of a similar nature: a binder such as microcrystalline cellulose, gum tragacanth or gelatin; an excipient such as starch or lactose, a disintegrating agent such as alginic acid, Primogel, or corn starch; a lubricant such as magnesium stearate or Sterotes; a glidant such as colloidal silicon dioxide; a sweetening agent such as sucrose or saccharin; or a flavoring agent such as peppermint, methyl salicylate, or orange flavoring.

For administration by inhalation, the compounds are delivered in the form of an aerosol spray from pressured container or dispenser which contains a suitable propellant, e.g., a gas such as carbon dioxide, or a nebulizer.

Systemic administration can also be by transmucosal or transdermal means. For transmucosal or transdermal administration, penetrants appropriate to the barrier to be permeated are used in the formulation. Such penetrants are generally known in the art, and include, for example, for transmucosal administration, detergents, bile salts, and fusidic acid derivatives. Transmucosal administration can be accomplished through the use of nasal sprays or suppositories. For transdermal administration, the active compounds are formulated into ointments, salves, gels, or creams as generally known in the art.

The compounds can also be prepared in the form of suppositories (e.g., with conventional suppository bases such as cocoa butter and other glycerides) or retention enemas for rectal delivery.

In one embodiment, the active compounds are prepared with carriers that will protect the compound against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Methods for preparation of such formulations will be apparent to those skilled in the art. The materials can also be obtained commercially from Alza Corporation and Nova Pharmaceuticals, Inc. Liposomal suspensions (including liposomes targeted to infected cells with monoclonal antibodies to viral antigens) can also be used as pharmaceutically acceptable carriers. These can be prepared according to methods known to those skilled in the art, for example, as described in U.S. Pat. No. 4,522,811.

It is advantageous to formulate oral or parenteral compositions in dosage unit form for ease of administration and uniformity of dosage. Dosage unit form as used herein refers to physically discrete units suited as unitary dosages for the subject to be treated; each unit containing a predetermined quantity of active compound calculated to produce the desired therapeutic effect in association with the required pharmaceutical carrier.

Toxicity and therapeutic efficacy of such compounds can be determined by standard pharmaceutical procedures in cell cultures or experimental animals, e.g., for determining the $LD_{50}$ (the dose lethal to 50% of the population) and the $ED_{50}$ (the dose therapeutically effective in 50% of the population). The dose ratio between toxic and therapeutic effects is the therapeutic index and it can be expressed as the ratio $LD_{50}/ED_{50}$. Compounds which exhibit high therapeutic indices are preferred. While compounds that exhibit toxic side effects can be used, care should be taken to design a delivery system that targets such compounds to the site of affected tissue in order to minimize potential damage to uninfected cells and, thereby, reduce side effects.

The data obtained from the cell culture assays and animal studies can be used in formulating a range of dosage for use in humans. The dosage of such compounds lies preferably within a range of circulating concentrations that include the $ED_{50}$ with little or no toxicity. The dosage can vary within this range depending upon the dosage form employed and the route of administration utilized. For any compound used in the method of the invention, the therapeutically effective dose can be estimated initially from cell culture assays. A dose can be formulated in animal models to achieve a circulating plasma concentration range that includes the $IC_{50}$ (i.e., the concentration of the test compound which achieves a half-maximal inhibition of symptoms) as determined in cell culture. Such information can be used to more accurately determine useful doses in humans. Levels in plasma can be measured, for example, by high performance liquid chromatography.

As defined herein, a therapeutically effective amount of protein or polypeptide (i.e., an effective dosage) ranges from about 0.001 to 30 mg/kg body weight, preferably about 0.01 to 25 mg/kg body weight, more preferably about 0.1 to 20 mg/kg body weight, and even more preferably about 1 to 10 mg/kg, 2 to 9 mg/kg, 3 to 8 mg/kg, 4 to 7 mg/kg, or 5 to 6 mg/kg body weight. The protein or polypeptide can be administered one time per week for between about 1 to 10 weeks, preferably between 2 to 8 weeks, more preferably between about 3 to 7 weeks, and even more preferably for about 4, 5, or 6 weeks. The skilled artisan will appreciate that certain factors can influence the dosage and timing required to effectively treat a subject, including but not limited to the severity of the disease or disorder, previous treatments, the general health and/or age of the subject, and other diseases present. Moreover, treatment of a subject with a therapeutically effective amount of a protein, polypeptide, or antibody, unconjugated or conjugated as described herein, can include a single treatment or, preferably, can include a series of treatments.

For antibodies, the preferred dosage is 0.1 mg/kg of body weight (generally 10 mg/kg to 20 mg/kg). If the antibody is to act in the brain, a dosage of 50 mg/kg to 100 mg/kg is usually appropriate. Generally, partially human antibodies and fully human antibodies have a longer half-life within the human body than other antibodies. Accordingly, lower dosages and less frequent administration is often possible. Modifications such as lipidation can be used to stabilize antibodies and to enhance uptake and tissue penetration (e.g., into the brain). A method for lipidation of antibodies is described by Cruikshank et al. ((1997) *J. Acquired Immune Deficiency Syndromes and Human Retrovirology* 14:193).

The present invention encompasses agents which modulate expression or activity. An agent can, for example, be a small molecule. For example, such small molecules include, but are not limited to, peptides, peptidomimetics (e.g., peptoids), amino acids, amino acid analogs, polynucleotides, polynucleotide analogs, nucleotides, nucleotide analogs, organic or inorganic compounds (i.e., including heteroorganic and organometallic compounds) having a molecular weight less than about 10,000 grams per mole, organic or inorganic compounds having a molecular weight less than about 5,000 grams per mole, organic or inorganic compounds having a molecular weight less than about 1,000 grams per mole, organic or inorganic compounds having a molecular weight less than about 500 grams per mole, and salts, esters, and other pharmaceutically acceptable forms of such compounds.

Exemplary doses include milligram or microgram amounts of the small molecule per kilogram of subject or sample weight (e.g., about 1 microgram per kilogram to about 500 milligrams per kilogram, about 100 micrograms per kilogram to about 5 milligrams per kilogram, or about 1 microgram per kilogram to about 50 micrograms per kilogram. It is furthermore understood that appropriate doses of a small molecule depend upon the potency of the small molecule with respect to the expression or activity to be modulated. When one or more of these small molecules is to be administered to an animal (e.g., a human) in order to modulate expression or activity of a polypeptide or nucleic acid of the invention, a physician, veterinarian, or researcher can, for example, prescribe a relatively low dose at first, subsequently increasing the dose until an appropriate response is obtained. In addition, it is understood that the specific dose level for any particular animal subject will depend upon a variety of factors including the activity of the specific compound employed, the age, body weight, general health, gender, and diet of the subject, the time of administration, the route of administration, the rate of excretion, any drug combination, and the degree of expression or activity to be modulated.

The nucleic acid molecules of the invention can be inserted into vectors and used as gene therapy vectors. Gene therapy vectors can be delivered to a subject by, for example, intravenous injection, local administration (see U.S. Pat. No. 5,328,470) or by stereotactic injection (see e.g., Chen et al. (1994) *Proc. Natl. Acad. Sci. USA* 91:3054-3057). The pharmaceutical preparation of the gene therapy vector can include the gene therapy vector in an acceptable diluent, or can comprise a slow release matrix in which the gene delivery vehicle is imbedded. Alternatively, where the complete gene delivery vector can be produced intact from recombinant cells, e.g., retroviral vectors, the pharmaceutical preparation can include one or more cells which produce the gene delivery system.

The pharmaceutical compositions can be included in a container, pack, or dispenser together with instructions for administration.

Methods of Treatment:

The present invention provides for both prophylactic and therapeutic methods of treating a subject at risk of (or susceptible to) a disorder or having a disorder associated with aberrant or unwanted 21910, 56634, 55053, 2504, 15977, 14760, 25501, 17903, 3700, 21529, 26176, 26343, 56638, 18610, 33217, 21967, h1983, m1983, 38555 or 593 expression or activity. As used herein, the term "treatment" is defined as the application or administration of a therapeutic agent to a patient, or application or administration of a therapeutic agent to an isolated tissue or cell line from a patient, who has a disease, a symptom of disease or a predisposition toward a disease, with the purpose to cure, heal, alleviate, relieve, alter, remedy, ameliorate, improve or affect the disease, the symptoms of disease or the predisposition toward disease. A therapeutic agent includes, but is not limited to, small molecules, peptides, antibodies, ribozymes and antisense oligonucleotides.

With regards to both prophylactic and therapeutic methods of treatment, such treatments can be specifically tailored or modified, based on knowledge obtained from the field of pharmacogenomics. "Pharmacogenomics", as used herein, refers to the application of genomics technologies such as gene sequencing, statistical genetics, and gene expression analysis to drugs in clinical development and on the market. More specifically, the term refers the study of how a patient's genes determine his or her response to a drug (e.g., a patient's "drug response phenotype", or "drug response genotype".) Thus, another aspect of the invention provides methods for tailoring an individual's prophylactic or therapeutic treatment with either the 21910, 56634, 55053, 2504, 15977, 14760, 25501, 17903, 3700, 21529, 26176, 26343, 56638, 18610, 33217, 21967, h1983, m1983, 38555 or 593 molecules of the present invention or 21910, 56634, 55053, 2504, 15977, 14760, 25501, 17903, 3700, 21529, 26176, 26343, 56638, 18610, 33217, 21967, h1983, m1983, 38555 or 593 modulators according to that individual's drug response genotype. Pharmacogenomics allows a clinician or physician to target prophylactic or therapeutic treatments to patients who will most benefit from the treatment and to avoid treatment of patients who will experience toxic drug-related side effects.

In one aspect, the invention provides a method for preventing in a subject, a disease or condition associated with an aberrant or unwanted 21910, 56634, 55053, 2504, 15977, 14760, 25501, 17903, 3700, 21529, 26176, 26343, 56638, 18610, 33217, 21967, h1983, m1983, 38555 or 593 expression or activity, by administering to the subject a 21910, 56634, 55053, 2504, 15977, 14760, 25501, 17903, 3700, 21529, 26176, 26343, 56638, 18610, 33217, 21967, h1983, m1983, 38555 or 593 or an agent which modulates 21910, 56634, 55053, 2504, 15977, 14760, 25501, 17903, 3700, 21529, 26176, 26343, 56638, 18610, 33217, 21967, h1983, m1983, 38555 or 593 expression or at least one 21910, 56634, 55053, 2504, 15977, 14760, 25501, 17903, 3700, 21529, 26176, 26343, 56638, 18610, 33217, 21967, h1983, m1983, 38555 or 593 activity. Subjects at risk for a disease which is caused or contributed to by aberrant or unwanted 21910, 56634, 55053, 2504, 15977, 14760, 25501, 17903, 3700, 21529, 26176, 26343, 56638, 18610, 33217, 21967, h1983, m1983, 38555 or 593 expression or activity can be identified by, for example, any or a combination of diagnostic or prognostic assays as described herein. Administration of a prophylactic agent can occur prior to the manifestation of symptoms characteristic of the 21910, 56634, 55053, 2504, 15977, 14760, 25501, 17903, 3700, 21529, 26176, 26343, 56638, 18610, 33217, 21967, h1983, m1983, 38555 or 593 aberrance, such that a disease or disorder is prevented or, alternatively, delayed in its progression. Depending on the type of 21910, 56634, 55053, 2504, 15977, 14760, 25501, 17903, 3700, 21529, 26176, 26343, 56638, 18610, 33217, 21967, h1983, m1983, 38555 or 593 aberrance, for example, a 21910, 56634, 55053, 2504, 15977, 14760, 25501, 17903, 3700, 21529, 26176, 26343, 56638, 18610, 33217, 21967, h1983, m1983, 38555 or 593, 21910, 56634, 55053, 2504, 15977, 14760, 25501, 17903, 3700, 21529, 26176, 26343, 56638, 18610, 33217, 21967, h1983, m1983, 38555 or 593 agonist or 21910, 56634, 55053, 2504, 15977, 14760, 25501, 17903, 3700, 21529, 26176, 26343, 56638, 18610, 33217, 21967, h1983, m1983, 38555 or 593 antagonist agent can be used for treating the subject. The appropriate agent can be determined based on screening assays described herein.

It is possible that some 21910, 56634, 55053, 2504, 15977, 14760, 25501, 17903, 3700, 21529, 26176, 26343, 56638, 18610, 33217, 21967, h1983, m1983, 38555 or 593 disorders can be caused, at least in part, by an abnormal level of gene product, or by the presence of a gene product exhibiting abnormal activity. As such, the reduction in the level and/or activity of such gene products would bring about the amelioration of disorder symptoms.

The 21910, 56634, 55053, 2504, 15977, 14760, 25501, 17903, 3700, 21529, 26176, 26343, 56638, 18610, 33217, 21967, h1983, m1983, 38555 or 593 molecules can act as novel diagnostic targets and therapeutic agents for controlling one or more of a cellular proliferative and/or differentiative disorder, brain disorder, platelet disorder, breast disorder, colon disorder, kidney (renal) disorder, lung disorder, ovarian disorder, prostate disorder, cervical disorder, spleen disorder, thymus disorder, thyroid disorder, testes disorder, hematopoeitic disorder, pancreatic disorder, skeletal muscle disorder, skin (dermal) disorder, disorder associated with bone metabolism, immune, e.g., inflammatory, disorder, cardiovascular disorder, endothelial cell disorder, liver disorder, viral disease, pain disorder, metabolic disorder, neurological or CNS disorder, erythroid disorder, blood vessel disorder or angiogenic disorder, all of which are described above.

As discussed, successful treatment of 21910, 56634, 55053, 2504, 15977, 14760, 25501, 17903, 3700, 21529, 26176, 26343, 56638, 18610, 33217, 21967, h1983, m1983, 38555 or 593 disorders can be brought about by techniques that serve to inhibit the expression or activity of target gene products. For example, compounds, e.g., an agent identified using an assays described above, that proves to exhibit negative modulatory activity, can be used in accordance with the invention to prevent and/or ameliorate symptoms of 21910, 56634, 55053, 2504, 15977, 14760, 25501, 17903, 3700, 21529, 26176, 26343, 56638, 18610, 33217, 21967, h1983, m1983, 38555 or 593 disorders. Such molecules can include, but are not limited to peptides, phosphopeptides, small organic or inorganic molecules, or antibodies (including, for example, polyclonal, monoclonal, humanized, human, anti-idiotypic, chimeric or single chain antibodies, and Fab, F(ab')$_2$ and Fab expression library fragments, scFV molecules, and epitope-binding fragments thereof).

Further, antisense and ribozyme molecules that inhibit expression of the target gene can also be used in accordance with the invention to reduce the level of target gene expression, thus effectively reducing the level of target gene activity. Still further, triple helix molecules can be utilized in reducing the level of target gene activity. Antisense, ribozyme and triple helix molecules are discussed above.

It is possible that the use of antisense, ribozyme, and/or triple helix molecules to reduce or inhibit mutant gene expression can also reduce or inhibit the transcription (triple helix) and/or translation (antisense, ribozyme) of mRNA produced by normal target gene alleles, such that the concentration of normal target gene product present can be lower than is necessary for a normal phenotype. In such cases, nucleic acid molecules that encode and express target gene polypeptides exhibiting normal target gene activity can be introduced into cells via gene therapy method. Alternatively, in instances in that the target gene encodes an extracellular protein, it can be preferable to co-administer normal target gene protein into the cell or tissue in order to maintain the requisite level of cellular or tissue target gene activity.

Another method by which nucleic acid molecules can be utilized in treating or preventing a disease characterized by 21910, 56634, 55053, 2504, 15977, 14760, 25501, 17903, 3700, 21529, 26176, 26343, 56638, 18610, 33217, 21967, h1983, m1983, 38555 or 593 expression is through the use of aptamer molecules specific for 21910, 56634, 55053, 2504, 15977, 14760, 25501, 17903, 3700, 21529, 26176, 26343, 56638, 18610, 33217, 21967, h1983, m1983, 38555 or 593 protein. Aptamers are nucleic acid molecules having a tertiary structure which permits them to specifically or selectively bind to protein ligands (see, e.g., Osborne et al. (1997) *Curr. Opin. Chem Biol.* 1: 5-9; and Patel (1997) *Curr Opin Chem Biol* 1:32-46). Since nucleic acid molecules can in many cases be more conveniently introduced into target cells than therapeutic protein molecules can be, aptamers offer a method by which 21910, 56634, 55053, 2504, 15977, 14760, 25501, 17903, 3700, 21529, 26176, 26343, 56638, 18610, 33217, 21967, h1983, m1983, 38555 or 593 protein activity can be specifically decreased without the introduction of drugs or other molecules which can have pluripotent effects.

Antibodies can be generated that are both specific for target gene product and that reduce target gene product activity. Such antibodies can, therefore, by administered in instances whereby negative modulatory techniques are appropriate for the treatment of 21910, 56634, 55053, 2504, 15977, 14760, 25501, 17903, 3700, 21529, 26176, 26343, 56638, 18610, 33217, 21967, h1983, m1983, 38555 or 593 disorders. For a description of antibodies, see the Antibody section above.

In circumstances wherein injection of an animal or a human subject with a 21910, 56634, 55053, 2504, 15977, 14760, 25501, 17903, 3700, 21529, 26176, 26343, 56638, 18610, 33217, 21967, h1983, m1983, 38555 or 593 protein or epitope for stimulating antibody production is harmful to the subject, it is possible to generate an immune response against 21910, 56634, 55053, 2504, 15977, 14760, 25501, 17903, 3700, 21529, 26176, 26343, 56638, 18610, 33217, 21967, h1983, m1983, 38555 or 593 through the use of anti-idiotypic antibodies (see, for example, Herlyn (1999) *Ann Med* 31:66-78; and Bhattacharya-Chatterjee and Foon (1998) *Cancer Treat Res.* 94:51-68). If an anti-idiotypic antibody is introduced into a mammal or human subject, it should stimulate the production of anti-anti-idiotypic antibodies, which should be specific to the 21910, 56634, 55053, 2504, 15977, 14760, 25501, 17903, 3700, 21529, 26176, 26343, 56638, 18610, 33217, 21967, h1983, m1983, 38555 or 593 protein.

Vaccines directed to a disease characterized by 21910, 56634, 55053, 2504, 15977, 14760, 25501, 17903, 3700, 21529, 26176, 26343, 56638, 18610, 33217, 21967, h1983, m1983, 38555 or 593 expression can also be generated in this fashion.

In instances where the target antigen is intracellular and whole antibodies are used, internalizing antibodies can be preferred. Lipofectin or liposomes can be used to deliver the antibody or a fragment of the Fab region that binds to the target antigen into cells. Where fragments of the antibody are used, the smallest inhibitory fragment that binds to the target antigen is preferred. For example, peptides having an amino acid sequence corresponding to the Fv region of the antibody can be used. Alternatively, single chain neutralizing antibodies that bind to intracellular target antigens can also be administered. Such single chain antibodies can be administered, for example, by expressing nucleotide sequences encoding single-chain antibodies within the target cell population (see e.g., Marasco et al. (1993) *Proc. Natl. Acad. Sci. USA* 90:7889-7893).

The identified compounds that inhibit target gene expression, synthesis and/or activity can be administered to a patient at therapeutically effective doses to prevent, treat or ameliorate 21910, 56634, 55053, 2504, 15977, 14760, 25501, 17903, 3700, 21529, 26176, 26343, 56638, 18610, 33217, 21967, h1983, m1983, 38555 or 593 disorders. A therapeutically effective dose refers to that amount of the compound sufficient to result in amelioration of symptoms of the disorders. Toxicity and therapeutic efficacy of such compounds can be determined by standard pharmaceutical procedures as described above.

The data obtained from the cell culture assays and animal studies can be used in formulating a range of dosage for use in humans. The dosage of such compounds lies preferably within a range of circulating concentrations that include the $ED_{50}$ with little or no toxicity. The dosage can vary within this range depending upon the dosage form employed and the route of administration utilized. For any compound used in the method of the invention, the therapeutically effective dose can be estimated initially from cell culture assays. A dose can be formulated in animal models to achieve a circulating plasma concentration range that includes the $IC_{50}$ (i.e., the concentration of the test compound that achieves a half-maximal inhibition of symptoms) as determined in cell culture. Such information can be used to more accurately determine useful doses in humans. Levels in plasma can be measured, for example, by high performance liquid chromatography.

Another example of determination of effective dose for an individual is the ability to directly assay levels of "free" and "bound" compound in the serum of the test subject. Such assays can utilize antibody mimics and/or "biosensors" that have been created through molecular imprinting techniques. The compound which is able to modulate 21910, 56634, 55053, 2504, 15977, 14760, 25501, 17903, 3700, 21529, 26176, 26343, 56638, 18610, 33217, 21967, h1983, m1983, 38555 or 593 activity is used as a template, or "imprinting molecule", to spatially organize polymerizable monomers prior to their polymerization with catalytic reagents. The subsequent removal of the imprinted molecule leaves a polymer matrix which contains a repeated "negative image" of the compound and is able to selectively rebind the molecule under biological assay conditions. A detailed review of this technique can be seen in Ansell et al (1996) *Current Opinion in Biotechnology* 7:89-94 and in Shea (1994) *Trends in PolymerScience* 2:166-173. Such "imprinted" affinity matrixes are amenable to ligand-binding assays, whereby the immobilized monoclonal antibody component is replaced by an appropriately imprinted matrix. An example of the use of such matrixes in this way can be seen in Vlatakis et al (1993) *Nature* 361:645-647. Through the use of isotope-labeling, the "free" concentration of compound which modulates the expression or activity of 21910, 56634, 55053, 2504, 15977, 14760, 25501, 17903, 3700, 21529, 26176, 26343, 56638, 18610, 33217, 21967, h1983, m1983, 38555 or 593 can be readily monitored and used in calculations of $IC_{50}$.

Such "imprinted" affinity matrixes can also be designed to include fluorescent groups whose photon-emitting properties measurably change upon local and selective binding of target compound. These changes can be readily assayed in real time using appropriate fiberoptic devices, in turn allowing the dose in a test subject to be quickly optimized based on its individual $IC_{50}$. An rudimentary example of such a "biosensor" is discussed in Kriz et al (1995) *Analytical Chemistry* 67:2142-2144.

Another aspect of the invention pertains to methods of modulating 21910, 56634, 55053, 2504, 15977, 14760, 25501, 17903, 3700, 21529, 26176, 26343, 56638, 18610, 33217, 21967, h1983, m1983, 38555 or 593 expression or activity for therapeutic purposes. Accordingly, in an exemplary embodiment, the modulatory method of the invention involves contacting a cell with a 21910, 56634, 55053, 2504, 15977, 14760, 25501, 17903, 3700, 21529, 26176, 26343, 56638, 18610, 33217, 21967, h1983, m1983, 38555 or 593 or agent that modulates one or more of the activities of 21910, 56634, 55053, 2504, 15977, 14760, 25501, 17903, 3700, 21529, 26176, 26343, 56638, 18610, 33217, 21967, h1983, m1983, 38555 or 593 protein activity associated with the cell. An agent that modulates 21910, 56634, 55053, 2504, 15977, 14760, 25501, 17903, 3700, 21529, 26176, 26343, 56638, 18610, 33217, 21967, h1983, m1983, 38555 or 593 protein activity can be an agent as described herein, such as a nucleic acid or a protein, a naturally-occurring target molecule of a 21910, 56634, 55053, 2504, 15977, 14760, 25501, 17903, 3700, 21529, 26176, 26343, 56638, 18610, 33217, 21967, h1983, m1983, 38555 or 593 protein (e.g., a 21910, 56634, 55053, 2504, 15977, 14760, 25501, 17903, 3700, 21529, 26176, 26343, 56638, 18610, 33217, 21967, h1983, m1983, 38555 or 593 substrate or receptor), a 21910, 56634, 55053, 2504, 15977, 14760, 25501, 17903, 3700, 21529, 26176, 26343, 56638, 18610, 33217, 21967, h1983, m1983, 38555 or 593 antibody, a 21910, 56634, 55053, 2504, 15977, 14760, 25501, 17903, 3700, 21529, 26176, 26343, 56638, 18610, 33217, 21967, h1983, m1983, 38555 or 593 agonist or antagonist, a peptidomimetic of a 21910, 56634, 55053, 2504, 15977, 14760, 25501, 17903, 3700, 21529, 26176, 26343, 56638, 18610, 33217, 21967, h1983, m1983, 38555 or 593 agonist or antagonist, or other small molecule.

In one embodiment, the agent stimulates one or 21910, 56634, 55053, 2504, 15977, 14760, 25501, 17903, 3700, 21529, 26176, 26343, 56638, 18610, 33217, 21967, h1983, m1983, 38555 or 593 activities. Examples of such stimulatory agents include active 21910, 56634, 55053, 2504, 15977, 14760, 25501, 17903, 3700, 21529, 26176, 26343, 56638, 18610, 33217, 21967, h1983, m1983, 38555 or 593 protein and a nucleic acid molecule encoding 21910, 56634, 55053, 2504, 15977, 14760, 25501, 17903, 3700, 21529, 26176, 26343, 56638, 18610, 33217, 21967, h1983, m1983, 38555 or 593. In another embodiment, the agent inhibits one or more 21910, 56634, 55053, 2504, 15977, 14760, 25501, 17903, 3700, 21529, 26176, 26343, 56638, 18610, 33217, 21967, h1983, m1983, 38555 or 593 activities. Examples of such inhibitory agents include antisense 21910, 56634, 55053, 2504, 15977, 14760, 25501, 17903, 3700, 21529, 26176, 26343, 56638, 18610, 33217, 21967, h1983, m1983, 38555 or 593 nucleic acid molecules, anti-21910, 56634, 55053, 2504, 15977, 14760, 25501, 17903, 3700, 21529, 26176, 26343, 56638, 18610, 33217, 21967, h1983, m1983, 38555 or 593 antibodies, and 21910, 56634, 55053, 2504, 15977, 14760, 25501, 17903, 3700, 21529, 26176, 26343, 56638, 18610, 33217, 21967, h1983, m1983, 38555 or 593 inhibitors. These modulatory methods can be performed in vitro (e.g., by culturing the cell with the agent) or, alternatively, in vivo (e.g., by administering the agent to a subject). As such, the present invention provides methods of treating an individual afflicted with a disease or disorder characterized by aberrant or unwanted expression or activity of a 21910, 56634, 55053, 2504, 15977, 14760, 25501, 17903, 3700, 21529, 26176, 26343, 56638, 18610, 33217, 21967, h1983, m1983, 38555 or 593 protein or nucleic acid molecule. In one embodiment, the method involves administering an agent (e.g., an agent identified by a screening assay described herein), or combination of agents that modulates (e.g., up regulates or down regulates) 21910, 56634, 55053, 2504, 15977, 14760, 25501, 17903, 3700, 21529, 26176, 26343, 56638, 18610, 33217, 21967, h1983, m1983, 38555 or 593 expression or activity. In another embodiment, the method involves administering a 21910, 56634, 55053, 2504, 15977, 14760, 25501, 17903, 3700, 21529, 26176, 26343, 56638, 18610, 33217, 21967, h1983, m1983, 38555 or 593 protein or nucleic acid molecule as therapy to compensate for reduced, aberrant, or unwanted 21910, 56634, 55053, 2504, 15977, 14760, 25501, 17903, 3700, 21529, 26176, 26343, 56638, 18610, 33217, 21967, h1983, m1983, 38555 or 593 expression or activity.

Stimulation of 21910, 56634, 55053, 2504, 15977, 14760, 25501, 17903, 3700, 21529, 26176, 26343, 56638, 18610, 33217, 21967, h1983, m1983, 38555 or 593 activity is desirable in situations in which 21910, 56634, 55053, 2504, 15977, 14760, 25501, 17903, 3700, 21529, 26176, 26343, 56638, 18610, 33217, 21967, h1983, m1983, 38555 or 593 is abnormally downregulated and/or in which increased 21910, 56634, 55053, 2504, 15977, 14760, 25501, 17903, 3700, 21529, 26176, 26343, 56638, 18610, 33217, 21967, h1983, m1983, 38555 or 593 activity is likely to have a beneficial effect. For example, stimulation of 21910, 56634, 55053, 2504, 15977, 14760, 25501, 17903, 3700, 21529, 26176, 26343, 56638, 18610, 33217, 21967, h1983, m1983, 38555 or 593 activity is desirable in situations in which a 21910, 56634, 55053, 2504, 15977, 14760, 25501, 17903, 3700, 21529, 26176, 26343, 56638, 18610, 33217, 21967, h1983, m1983, 38555 or 593 is downregulated and/or in which increased 21910, 56634, 55053, 2504, 15977, 14760, 25501, 17903, 3700, 21529, 26176, 26343, 56638, 18610, 33217, 21967, h1983, m1983, 38555 or 593 activity is likely to have a beneficial effect. Likewise, inhibition of 21910, 56634, 55053, 2504, 15977, 14760, 25501, 17903, 3700, 21529, 26176, 26343, 56638, 18610, 33217, 21967, h1983, m1983, 38555 or 593 activity is desirable in situations in which 21910, 56634, 55053, 2504, 15977, 14760, 25501, 17903, 3700, 21529, 26176, 26343, 56638, 18610, 33217, 21967, h1983, m1983, 38555 or 593 is abnormally upregulated and/or in which decreased 21910, 56634, 55053, 2504, 15977, 14760, 25501, 17903, 3700, 21529, 26176, 26343, 56638, 18610, 33217, 21967, h1983, m1983, 38555 or 593 activity is likely to have a beneficial effect.

Pharmacogenomics

The 21910, 56634, 55053, 2504, 15977, 14760, 25501, 17903, 3700, 21529, 26176, 26343, 56638, 18610, 33217, 21967, h1983, m1983, 38555 or 593 molecules of the present invention, as well as agents, or modulators which have a stimulatory or inhibitory effect on 21910, 56634, 55053, 2504, 15977, 14760, 25501, 17903, 3700, 21529, 26176, 26343, 56638, 18610, 33217, 21967, h1983, m1983, 38555 or 593 activity (e.g., 21910, 56634, 55053, 2504, 15977, 14760, 25501, 17903, 3700, 21529, 26176, 26343, 56638, 18610, 33217, 21967, h1983, m1983, 38555 or 593 gene expression) as identified by a screening assay described herein can be administered to individuals to treat (prophylactically or therapeutically) 21910, 56634, 55053, 2504, 15977, 14760, 25501, 17903, 3700, 21529, 26176, 26343, 56638, 18610, 33217, 21967, h1983, m1983, 38555 or 593-associated disorders (e.g., aberrant or deficient guanylate kinase activity, phophatidylinositol 4-phosphate 5-kinase activity, kinase activity, transferase activity, aminopeptidase activity, adenylate cyclase activity, calpain protease activity, oxidoreductase activity, neprilysin protease activity, AMP binding enzyme activity or lysyl oxidase activity) associated with aberrant or unwanted 21910, 56634, 55053, 2504, 15977, 14760, 25501, 17903, 3700, 21529, 26176, 26343, 56638, 18610, 33217, 21967, h1983, m1983, 38555 or 593 activity.

In conjunction with such treatment, pharmacogenomics (i.e., the study of the relationship between an individual's genotype and that individual's response to a foreign compound or drug) can be considered. Differences in metabolism of therapeutics can lead to severe toxicity or therapeutic failure by altering the relation between dose and blood concentration of the pharmacologically active drug. Thus, a physician or clinician can consider applying knowledge obtained in relevant pharmacogenomics studies in determining whether to administer a 21910, 56634, 55053, 2504, 15977, 14760, 25501, 17903, 3700, 21529, 26176, 26343, 56638, 18610, 33217, 21967, h1983, m1983, 38555 or 593 molecule or 21910, 56634, 55053, 2504, 15977, 14760, 25501, 17903, 3700, 21529, 26176, 26343, 56638, 18610, 33217, 21967, h1983, m1983, 38555 or 593 modulator as well as tailoring the dosage and/or therapeutic regimen of treatment with a 21910, 56634, 55053, 2504, 15977, 14760, 25501, 17903, 3700, 21529, 26176, 26343, 56638, 18610, 33217, 21967, h1983, m1983, 38555 or 593 molecule or 21910, 56634, 55053, 2504, 15977, 14760, 25501, 17903, 3700, 21529, 26176, 26343, 56638, 18610, 33217, 21967, h1983, m1983, 38555 or 593 modulator.

Pharmacogenomics deals with clinically significant hereditary variations in the response to drugs due to altered drug disposition and abnormal action in affected persons. See, for example, Eichelbaum et al. (1996) *Clin. Exp. Pharmacol. Physiol.* 23:983-985 and Linder et al. (1997) *Clin. Chem.* 43:254-266. In general, two types of pharmacogenetic conditions can be differentiated. Genetic conditions transmitted as a single factor altering the way drugs act on the body (altered drug action) or genetic conditions transmitted as single factors altering the way the body acts on drugs (altered drug metabolism). These pharmacogenetic conditions can occur either as rare genetic defects or as naturally-occurring polymorphisms. For example, glucose-6-phosphate dehydrogenase deficiency (G6PD) is a common inherited enzymopathy in which the main clinical complication is haemolysis after ingestion of oxidant drugs (anti-malarials, sulfonamides, analgesics, nitrofurans) and consumption of fava beans.

One pharmacogenomics approach to identifying genes that predict drug response, known as "a genome-wide association", relies primarily on a high-resolution map of the human genome consisting of already known gene-related markers (e.g., a "bi-allelic" gene marker map which consists of 60,000 polymorphic or variable sites on the human genome, each of which has two variants.) Such a high-resolution genetic map can be compared to a map of the genome of each of a statistically significant number of patients taking part in a Phase II/III drug trial to identify markers associated with a particular observed drug response or side effect. Alternatively, such a high resolution map can be generated from a combination of some ten-million known single nucleotide polymorphisms (SNPs) in the human genome. As used herein, a "SNP" is a common alteration that occurs in a single nucleotide base in a stretch of DNA. For example, a SNP can occur once per every 1000 bases of DNA. A SNP can be involved in a disease process, however, the vast majority can not be disease-associated. Given a genetic map based on the occurrence of such SNPs, individuals can be grouped into genetic categories depending on a particular pattern of SNPs in their individual genome. In such a manner, treatment regimens can be tailored to groups of genetically similar individuals, taking into account traits that can be common among such genetically similar individuals.

Alternatively, a method termed the "candidate gene approach", can be utilized to identify genes that predict drug response. According to this method, if a gene that encodes a drug's target is known (e.g., a 21910, 56634, 55053, 2504, 15977, 14760, 25501, 17903, 3700, 21529, 26176, 26343, 56638, 18610, 33217, 21967, h1983, m1983, 38555 or 593 protein of the present invention), all common variants of that gene can be fairly easily identified in the population and it can be determined if having one version of the gene versus another is associated with a particular drug response.

Alternatively, a method termed the "gene expression profiling", can be utilized to identify genes that predict drug response. For example, the gene expression of an animal dosed with a drug (e.g., a 21910, 56634, 55053, 2504, 15977, 14760, 25501, 17903, 3700, 21529, 26176, 26343, 56638, 18610, 33217, 21967, h1983, m1983, 38555 or 593 molecule or 21910, 56634, 55053, 2504, 15977, 14760, 25501, 17903, 3700, 21529, 26176, 26343, 56638, 18610, 33217, 21967, h1983, m1983, 38555 or 593 modulator of the present invention) can give an indication whether gene pathways related to toxicity have been turned on.

Information generated from more than one of the above pharmacogenomics approaches can be used to determine appropriate dosage and treatment regimens for prophylactic or therapeutic treatment of an individual. This knowledge, when applied to dosing or drug selection, can avoid adverse reactions or therapeutic failure and thus enhance therapeutic or prophylactic efficiency when treating a subject with a 21910, 56634, 55053, 2504, 15977, 14760, 25501, 17903, 3700, 21529, 26176, 26343, 56638, 18610, 33217, 21967, h1983, m1983, 38555 or 593 molecule or 21910, 56634, 55053, 2504, 15977, 14760, 25501, 17903, 3700, 21529, 26176, 26343, 56638, 18610, 33217, 21967, h1983, m1983, 38555 or 593 modulator, such as a modulator identified by one of the exemplary screening assays described herein.

The present invention further provides methods for identifying new agents, or combinations, that are based on identifying agents that modulate the activity of one or more of the gene products encoded by one or more of the 21910, 56634, 55053, 2504, 15977, 14760, 25501, 17903, 3700, 21529, 26176, 26343, 56638, 18610, 33217, 21967, h1983, m1983, 38555 or 593 genes of the present invention, wherein these products can be associated with resistance of the cells to a therapeutic agent. Specifically, the activity of the proteins encoded by the 21910, 56634, 55053, 2504, 15977, 14760, 25501, 17903, 3700, 21529, 26176, 26343, 56638, 18610, 33217, 21967, h1983, m1983, 38555 or 593 genes of the present invention can be used as a basis for identifying agents for overcoming agent resistance. By blocking the activity of one or more of the resistance proteins, target cells, e.g., human cells, will become sensitive to treatment with an agent to which the unmodified target cells were resistant.

Monitoring the influence of agents (e.g., drugs) on the expression or activity of a 21910, 56634, 55053, 2504, 15977, 14760, 25501, 17903, 3700, 21529, 26176, 26343, 56638, 18610, 33217, 21967, h1983, m1983, 38555 or 593 protein can be applied in clinical trials. For example, the effectiveness of an agent determined by a screening assay as described herein to increase 21910, 56634, 55053, 2504, 15977, 14760, 25501, 17903, 3700, 21529, 26176, 26343, 56638, 18610, 33217, 21967, h1983, m1983, 38555 or 593 gene expression, protein levels, or upregulate 21910, 56634, 55053, 2504, 15977, 14760, 25501, 17903, 3700, 21529, 26176, 26343, 56638, 18610, 33217, 21967, h1983, m1983, 38555 or 593 activity, can be monitored in clinical trials of subjects exhibiting decreased 21910, 56634, 55053, 2504, 15977, 14760, 25501, 17903, 3700, 21529, 26176, 26343, 56638, 18610, 33217, 21967, h1983, m1983, 38555 or 593 gene expression, protein levels, or downregulated 21910, 56634, 55053, 2504, 15977, 14760, 25501, 17903, 3700, 21529, 26176, 26343, 56638, 18610, 33217, 21967, h1983, m1983, 38555 or 593 activity. Alternatively, the effectiveness of an agent determined by a screening assay to decrease 21910, 56634, 55053, 2504, 15977, 14760, 25501, 17903, 3700, 21529, 26176, 26343, 56638, 18610, 33217, 21967, h1983, m1983, 38555 or 593 gene expression, protein levels, or down-regulate 21910, 56634, 55053, 2504, 15977, 14760, 25501, 17903, 3700, 21529, 26176, 26343, 56638, 18610, 33217, 21967, h1983, m1983, 38555 or 593 activity, can be monitored in clinical trials of subjects exhibiting increased 21910, 56634, 55053, 2504, 15977, 14760, 25501, 17903, 3700, 21529, 26176, 26343, 56638, 18610, 33217, 21967, h1983, m1983, 38555 or 593 gene expression, protein levels, or upregulated 21910, 56634, 55053, 2504, 15977, 14760, 25501, 17903, 3700, 21529, 26176, 26343, 56638, 18610, 33217, 21967, h1983, m1983, 38555 or 593 activity. In such clinical trials, the expression or activity of a 21910, 56634, 55053, 2504, 15977, 14760, 25501, 17903, 3700, 21529, 26176, 26343, 56638, 18610, 33217, 21967, h1983, m1983, 38555 or 593 gene, and preferably, other genes that have been implicated in, for example, a protein kinase-associated or another 21910, 56634, 55053, 2504, 15977, 14760, 25501, 17903, 3700, 21529, 26176, 26343, 56638, 18610, 33217, 21967, h1983, m1983, 38555 or 593-associated disorder can be used as a "read out" or markers of the phenotype of a particular cell.

Other Embodiments

In another aspect, the invention features a method of analyzing a plurality of capture probes. The method is useful, e.g., to analyze gene expression. The method includes: providing a two dimensional array having a plurality of addresses, each address of the plurality being positionally distinguishable from each other address of the plurality, and each address of the plurality having a unique capture probe, e.g., a nucleic acid or peptide sequence, wherein the capture probes are from a cell or subject which expresses 21910, 56634, 55053, 2504, 15977, 14760, 25501, 17903, 3700, 21529, 26176, 26343, 56638, 18610, 33217, 21967, h1983, m1983, 38555 or 593 or from a cell or subject in which a 21910, 56634, 55053, 2504, 15977, 14760, 25501, 17903, 3700, 21529, 26176, 26343, 56638, 18610, 33217, 21967, h1983, m1983, 38555 or 593 mediated response has been elicited; contacting the array with a 21910, 56634, 55053, 2504, 15977, 14760, 25501, 17903, 3700, 21529, 26176, 26343, 56638, 18610, 33217, 21967, h1983, m1983, 38555 or 593 nucleic acid (preferably purified), a 21910, 56634, 55053, 2504, 15977, 14760, 25501, 17903, 3700, 21529, 26176, 26343, 56638, 18610, 33217, 21967, h1983, m1983, 38555 or 593 polypeptide (preferably purified), or an anti-21910, 56634, 55053, 2504, 15977, 14760, 25501, 17903, 3700, 21529, 26176, 26343, 56638, 18610, 33217, 21967, h1983, m1983, 38555 or 593 antibody, and thereby evaluating the plurality of capture probes. Binding, e.g., in the case of a nucleic acid, hybridization with a capture probe at an address of the plurality, is detected, e.g., by a signal generated from a label attached to the 21910, 56634, 55053, 2504, 15977, 14760, 25501, 17903, 3700, 21529, 26176, 26343, 56638, 18610, 33217, 21967, h1983, m1983, 38555 or 593 nucleic acid, polypeptide, or antibody.

The capture probes can be a set of nucleic acids from a selected sample, e.g., a sample of nucleic acids derived from a control or non-stimulated tissue or cell.

The method can include contacting the 21910, 56634, 55053, 2504, 15977, 14760, 25501, 17903, 3700, 21529, 26176, 26343, 56638, 18610, 33217, 21967, h1983, m1983, 38555 or 593 nucleic acid, polypeptide, or antibody with a first array having a plurality of capture probes and a second array having a different plurality of capture probes. The results of each hybridization can be compared, e.g., to analyze differences in expression between a first and second sample. The first plurality of capture probes can be from a control sample, e.g., a wild type, normal, or non-diseased, non-stimulated, sample, e.g., a biological fluid, tissue, or cell sample. The second plurality of capture probes can be from an experimental sample, e.g., a mutant type, at risk, disease-state or disorder-state, or stimulated, sample, e.g., a biological fluid, tissue, or cell sample.

The plurality of capture probes can be a plurality of nucleic acid probes each of which specifically hybridizes, with an allele of 21910, 56634, 55053, 2504, 15977, 14760, 25501, 17903, 3700, 21529, 26176, 26343, 56638, 18610, 33217, 21967, h1983, m1983, 38555 or 593. Such methods can be used to diagnose a subject, e.g., to evaluate risk for a disease or disorder, to evaluate suitability of a selected treatment for a subject, to evaluate whether a subject has a disease or disorder.

The method can be used to detect SNPs, as described above.

In another aspect, the invention features, a method of analyzing 21910, 56634, 55053, 2504, 15977, 14760, 25501, 17903, 3700, 21529, 26176, 26343, 56638, 18610, 33217, 21967, h1983, m1983, 38555 or 593, e.g., analyzing structure, function, or relatedness to other nucleic acid or amino acid sequences. The method includes: providing a 21910, 56634, 55053, 2504, 15977, 14760, 25501, 17903, 3700, 21529, 26176, 26343, 56638, 18610, 33217, 21967, h1983, m1983, 38555 or 593 nucleic acid or amino acid sequence; comparing the 21910, 56634, 55053, 2504, 15977, 14760, 25501, 17903, 3700, 21529, 26176, 26343, 56638, 18610, 33217, 21967, h1983, m1983, 38555 or 593 sequence with one or more preferably a plurality of sequences from a collection of sequences, e.g., a nucleic acid or protein sequence database; to thereby analyze 21910, 56634, 55053, 2504, 15977, 14760, 25501, 17903, 3700, 21529, 26176, 26343, 56638, 18610, 33217, 21967, h1983, m1983, 38555 or 593.

The method can include evaluating the sequence identity between a 21910, 56634, 55053, 2504, 15977, 14760, 25501, 17903, 3700, 21529, 26176, 26343, 56638, 18610, 33217, 21967, h1983, m1983, 38555 or 593 sequence and a database sequence. The method can be performed by accessing the database at a second site, e.g., over the internet. Preferred databases include GenBank™ and SwissProt.

In another aspect, the invention features, a set of oligonucleotides, useful, e.g., for identifying SNP's, or identifying specific alleles of 21910, 56634, 55053, 2504, 15977, 14760, 25501, 17903, 3700, 21529, 26176, 26343, 56638, 18610, 33217, 21967, h1983, m1983, 38555 or 593. The set includes a plurality of oligonucleotides, each of which has a different nucleotide at an interrogation position, e.g., an SNP or the site of a mutation. In a preferred embodiment, the oligonucleotides of the plurality identical in sequence with one another (except for differences in length). The oligonucleotides can be provided with differential labels, such that an oligonucleotide which hybridizes to one allele provides a signal that is distinguishable from an oligonucleotide which hybridizes to a second allele.

The sequences of 21910, 56634, 55053, 2504, 15977, 14760, 25501, 17903, 3700, 21529, 26176, 26343, 56638, 18610, 33217, 21967, h1983, m1983, 38555 or 593 molecules are provided in a variety of mediums to facilitate use thereof. A sequence can be provided as a manufacture, other than an isolated nucleic acid or amino acid molecule, which contains a 21910, 56634, 55053, 2504, 15977, 14760, 25501, 17903, 3700, 21529, 26176, 26343, 56638, 18610, 33217, 21967, h1983, m1983, 38555 or 593 molecule. Such a manufacture can provide a nucleotide or amino acid sequence, e.g., an open reading frame, in a form which allows examination of the manufacture using means not directly applicable to examining the nucleotide or amino acid sequences, or a subset thereof, as they exist in nature or in purified form.

A 21910, 56634, 55053, 2504, 15977, 14760, 25501, 17903, 3700, 21529, 26176, 26343, 56638, 18610, 33217, 21967, h1983, m1983, 38555 or 593 nucleotide or amino acid sequence can be recorded on computer readable media. As used herein, "computer readable media" refers to any medium that can be read and accessed directly by a computer. Such media include, but are not limited to: magnetic storage media, such as floppy discs, hard disc storage medium, and magnetic tape; optical storage media such as compact disc and CD-ROM; electrical storage media such as RAM, ROM, EPROM, EEPROM, and the like; and general hard disks and hybrids of these categories such as magnetic/optical storage media. The medium is adapted or configured for having thereon 21910, 56634, 55053, 2504, 15977, 14760, 25501, 17903, 3700, 21529, 26176, 26343, 56638, 18610, 33217, 21967, h1983, m1983, 38555 or 593 sequence information of the present invention.

As used herein, the term "electronic apparatus" is intended to include any suitable computing or processing apparatus of other device configured or adapted for storing data or information. Examples of electronic apparatus suitable for use with the present invention include stand-alone computing apparatus; networks, including a local area network (LAN), a wide area network (WAN) Internet, Intranet, and Extranet; electronic appliances such as personal digital assistants (PDAs), cellular phones, pagers, and the like; and local and distributed processing systems.

As used herein, "recorded" refers to a process for storing or encoding information on the electronic apparatus readable medium. Those skilled in the art can readily adopt any of the presently known methods for recording information on known media to generate manufactures comprising the 21910, 56634, 55053, 2504, 15977, 14760, 25501, 17903, 3700, 21529, 26176, 26343, 56638, 18610, 33217, 21967, h1983, m1983, 38555 or 593 sequence information.

A variety of data storage structures are available to a skilled artisan for creating a computer readable medium having recorded thereon a 21910, 56634, 55053, 2504, 15977, 14760, 25501, 17903, 3700, 21529, 26176, 26343, 56638, 18610, 33217, 21967, h1983, m1983, 38555 or 593 nucleotide or amino acid sequence of the present invention. The choice of the data storage structure will generally be based on the means chosen to access the stored information. In addition, a variety of data processor programs and formats can be used to store the nucleotide sequence information of the present invention on computer readable medium. The sequence information can be represented in a word processing text file, formatted in commercially-available software such as WordPerfect and Microsoft Word, or represented in the form of an ASCII file, stored in a database application, such as DB2, Sybase, Oracle, or the like. The skilled artisan can readily adapt any number of data processor structuring formats (e.g., text file or database) in order to obtain computer readable medium having recorded thereon the nucleotide sequence information of the present invention.

By providing the 21910, 56634, 55053, 2504, 15977, 14760, 25501, 17903, 3700, 21529, 26176, 26343, 56638, 18610, 33217, 21967, h1983, m1983, 38555 or 593 nucleotide or amino acid sequences of the invention in computer readable form, the skilled artisan can routinely access the sequence information for a variety of purposes. For example, one skilled in the art can use the nucleotide or amino acid sequences of the invention in computer readable form to compare a target sequence or target structural motif with the sequence information stored within the data storage means. A search is used to identify fragments or regions of the sequences of the invention which match a particular target sequence or target motif.

The present invention therefore provides a medium for holding instructions for performing a method for determining whether a subject has a guanylate kinase, phophatidylinositol 4-phosphate 5-kinase, kinase, transferase, aminopeptidase, adenylate cyclase, calpain protease, oxidoreductase, neprilysin protease, AMP binding enzyme or lysyl oxidase-associated or another 21910, 56634, 55053, 2504, 15977, 14760, 25501, 17903, 3700, 21529, 26176, 26343, 56638, 18610, 33217, 21967, h1983, m1983, 38555 or 593-associated disease or disorder or a pre-disposition to a guanylate kinase, phophatidylinositol 4-phosphate 5-kinase, kinase, transferase, aminopeptidase, adenylate cyclase, calpain protease, oxidoreductase, neprilysin protease, AMP binding enzyme or lysyl oxidase-associated or another 21910, 56634, 55053, 2504, 15977, 14760, 25501, 17903, 3700, 21529, 26176, 26343, 56638, 18610, 33217, 21967, h1983, m1983, 38555 or 593-associated disease or disorder, wherein the method comprises the steps of determining 21910, 56634, 55053, 2504, 15977, 14760, 25501, 17903, 3700, 21529, 26176, 26343, 56638, 18610, 33217, 21967, h1983, m1983, 38555 or 593 sequence information associated with the subject and based on the 21910, 56634, 55053, 2504, 15977, 14760, 25501, 17903, 3700, 21529, 26176, 26343, 56638, 18610, 33217, 21967, h1983, m1983, 38555 or 593 sequence information, determining whether the subject has a guanylate kinase, phophatidylinositol 4-phosphate 5-kinase, kinase, transferase, aminopeptidase, adenylate cyclase, calpain protease, oxidoreductase, neprilysin protease, AMP binding enzyme or lysyl oxidase-associated or another 21910, 56634, 55053, 2504, 15977, 14760, 25501, 17903, 3700, 21529, 26176, 26343, 56638, 18610, 33217, 21967, h1983, m1983, 38555 or 593-associated disease or disorder and/or recommending a particular treatment for the disease, disorder, or pre-disease condition.

The present invention further provides in an electronic system and/or in a network, a method for determining whether a subject has a guanylate kinase, phophatidylinositol 4-phosphate 5-kinase, kinase, transferase, aminopeptidase, adenylate cyclase, calpain protease, oxidoreductase, neprilysin protease, AMP binding enzyme or lysyl oxidase-associated or another 21910, 56634, 55053, 2504, 15977, 14760, 25501, 17903, 3700, 21529, 26176, 26343, 56638, 18610, 33217, 21967, h1983, m1983, 38555 or 593-associated disease or disorder or a pre-disposition to a disease associated with 21910, 56634, 55053, 2504, 15977, 14760, 25501, 17903, 3700, 21529, 26176, 26343, 56638, 18610, 33217, 21967, h1983, m1983, 38555 or 593, wherein the method comprises the steps of determining 21910, 56634, 55053, 2504, 15977, 14760, 25501, 17903, 3700, 21529, 26176, 26343, 56638, 18610, 33217, 21967, h1983, m1983, 38555 or 593 sequence information associated with the subject, and based on the 21910, 56634, 55053, 2504, 15977, 14760, 25501, 17903, 3700, 21529, 26176, 26343, 56638, 18610, 33217, 21967, h1983, m1983, 38555 or 593 sequence information, determining whether the subject has a guanylate kinase, phophatidylinositol 4-phosphate 5-kinase, kinase, transferase, aminopeptidase, adenylate cyclase, calpain protease, oxidoreductase, neprilysin protease, AMP binding enzyme or lysyl oxidase-associated or another 21910, 56634, 55053, 2504, 15977, 14760, 25501, 17903, 3700, 21529, 26176, 26343, 56638, 18610, 33217, 21967, h1983, m1983, 38555 or 593-associated disease or disorder or a pre-disposition to a guanylate kinase, phophatidylinositol 4-phosphate 5-kinase, kinase, transferase, aminopeptidase, adenylate cyclase, calpain protease, oxidoreductase, neprilysin protease, AMP binding enzyme or lysyl oxidase-associated or another 21910, 56634, 55053, 2504, 15977, 14760, 25501, 17903, 3700, 21529, 26176, 26343, 56638, 18610, 33217, 21967, h1983, m1983, 38555 or 593-associated disease or disorder, and/or recommending a particular treatment for the disease, disorder, or pre-disease condition. The method may further comprise the step of receiving phenotypic information associated with the subject and/or acquiring from a network phenotypic information associated with the subject.

The present invention also provides in a network, a method for determining whether a subject has a guanylate kinase, phophatidylinositol 4-phosphate 5-kinase, kinase, transferase, aminopeptidase, adenylate cyclase, calpain protease, oxidoreductase, neprilysin protease, AMP binding enzyme or lysyl oxidase-associated or another 21910, 56634, 55053, 2504, 15977, 14760, 25501, 17903, 3700, 21529, 26176, 26343, 56638, 18610, 33217, 21967, h1983, m1983, 38555 or 593-associated disease or disorder or a pre-disposition to a guanylate kinase, phophatidylinositol 4-phosphate 5-kinase, kinase, transferase, aminopeptidase, adenylate cyclase, calpain protease, oxidoreductase, neprilysin protease, AMP binding enzyme or lysyl oxidase-associated or another 21910, 56634, 55053, 2504, 15977, 14760, 25501, 17903, 3700, 21529, 26176, 26343, 56638, 18610, 33217, 21967, h1983, m1983, 38555 or 593-associated disease or disorder, said method comprising the steps of receiving 21910, 56634, 55053, 2504, 15977, 14760, 25501, 17903, 3700, 21529, 26176, 26343, 56638, 18610, 33217, 21967, h1983, m1983, 38555 or 593 sequence information from the subject and/or information related thereto, receiving phenotypic information associated with the subject, acquiring information from the network corresponding to 21910, 56634, 55053, 2504, 15977, 14760, 25501, 17903, 3700, 21529, 26176, 26343, 56638, 18610, 33217, 21967, h1983, m1983, 38555 or 593 and/or corresponding to a guanylate kinase, phophatidylinositol 4-phosphate 5-kinase, kinase, transferase, aminopeptidase, adenylate cyclase, calpain protease, oxidoreductase, neprilysin protease, AMP binding enzyme or lysyl oxidase-associated or another 21910, 56634, 55053, 2504, 15977, 14760, 25501, 17903, 3700, 21529, 26176, 26343, 56638, 18610, 33217, 21967, h1983, m1983, 38555 or 593-associated disease or disorder, and based on one or more of the phenotypic information, the 21910, 56634, 55053, 2504, 15977, 14760, 25501, 17903, 3700, 21529, 26176, 26343, 56638, 18610, 33217, 21967, h1983, m1983, 38555 or 593 information (e.g., sequence information and/or information related thereto), and the acquired information, determining whether the subject has a guanylate kinase, phophatidylinositol 4-phosphate 5-kinase, kinase, transferase, aminopeptidase, adenylate cyclase, calpain protease, oxidoreductase, neprilysin protease, AMP binding enzyme or lysyl oxidase-associated or another 21910, 56634, 55053, 2504, 15977, 14760, 25501, 17903, 3700, 21529, 26176, 26343, 56638, 18610, 33217, 21967, h1983, m1983, 38555 or 593-associated disease or disorder or a pre-disposition to a guanylate kinase, phophatidylinositol 4-phosphate 5-kinase, kinase, transferase, aminopeptidase, adenylate cyclase, calpain protease, oxidoreductase, neprilysin protease, AMP binding enzyme or lysyl oxidase-associated or another 21910, 56634, 55053, 2504, 15977, 14760, 25501, 17903, 3700, 21529, 26176, 26343, 56638, 18610, 33217, 21967, h1983, m1983, 38555 or 593-associated disease or disorder. The method may further comprise the step of recommending a particular treatment for the disease, disorder, or pre-disease condition.

The present invention also provides a business method for determining whether a subject has a guanylate kinase, phophatidylinositol 4-phosphate 5-kinase, kinase, transferase, aminopeptidase, adenylate cyclase, calpain protease, oxidoreductase, neprilysin protease, AMP binding enzyme or lysyl oxidase-associated or another 21910, 56634, 55053, 2504, 15977, 14760, 25501, 17903, 3700, 21529, 26176, 26343, 56638, 18610, 33217, 21967, h1983, m1983, 38555 or 593-associated disease or disorder or a pre-disposition to a guanylate kinase, phophatidylinositol 4-phosphate 5-kinase, kinase, transferase, aminopeptidase, adenylate cyclase, calpain protease, oxidoreductase, neprilysin protease, AMP binding enzyme or lysyl oxidase-associated or another 21910, 56634, 55053, 2504, 15977, 14760, 25501, 17903, 3700, 21529, 26176, 26343, 56638, 18610, 33217, 21967, h1983, m1983, 38555 or 593-associated disease or disorder, said method comprising the steps of receiving information related to 21910, 56634, 55053, 2504, 15977, 14760, 25501, 17903, 3700, 21529, 26176, 26343, 56638, 18610, 33217, 21967, h1983, m1983, 38555 or 593 (e.g., sequence information and/or information related thereto), receiving phenotypic information associated with the subject, acquiring information from the network related to 21910, 56634, 55053, 2504, 15977, 14760, 25501, 17903, 3700, 21529, 26176, 26343, 56638, 18610, 33217, 21967, h1983, m1983, 38555 or 593 and/or related to a guanylate kinase, phophatidylinositol 4-phosphate 5-kinase, kinase, transferase, aminopeptidase, adenylate cyclase, calpain protease, oxidoreductase, neprilysin protease, AMP binding enzyme or lysyl oxidase-associated or another 21910, 56634, 55053, 2504, 15977, 14760, 25501, 17903, 3700, 21529, 26176, 26343, 56638, 18610, 33217, 21967, h1983, m1983, 38555 or 593-associated disease or disorder, and based on one or more of the phenotypic information, the 21910, 56634, 55053, 2504, 15977, 14760, 25501, 17903, 3700, 21529, 26176, 26343, 56638, 18610, 33217, 21967, h1983, m1983, 38555 or 593 information, and the acquired information, determining whether the subject has a guanylate kinase, phophatidylinositol 4-phosphate 5-kinase, kinase, transferase, aminopeptidase, adenylate cyclase, calpain protease, oxidoreductase, neprilysin protease, AMP binding enzyme or lysyl oxidase-associated or another 21910, 56634, 55053, 2504, 15977, 14760, 25501, 17903, 3700, 21529, 26176, 26343, 56638, 18610, 33217, 21967, h1983, m1983, 38555 or 593-associated disease or disorder or a pre-disposition to a guanylate kinase, phophatidylinositol 4-phosphate 5-kinase, kinase, transferase, aminopeptidase, adenylate cyclase, calpain protease, oxidoreductase, neprilysin protease, AMP binding enzyme or lysyl oxidase-associated or another 21910, 56634, 55053, 2504, 15977, 14760, 25501, 17903, 3700, 21529, 26176, 26343, 56638, 18610, 33217, 21967, h1983, m1983, 38555 or 593-associated disease or disorder. The method may further comprise the step of recommending a particular treatment for the disease, disorder, or pre-disease condition.

The invention also includes an array comprising a 21910, 56634, 55053, 2504, 15977, 14760, 25501, 17903, 3700, 21529, 26176, 26343, 56638, 18610, 33217, 21967, h1983, m1983, 38555 or 593 sequence of the present invention. The array can be used to assay expression of one or more genes in the array. In one embodiment, the array can be used to assay gene expression in a tissue to ascertain tissue specificity of genes in the array. In this manner, up to about 7600 genes can be simultaneously assayed for expression, one of which can be 21910, 56634, 55053, 2504, 15977, 14760, 25501, 17903, 3700, 21529, 26176, 26343, 56638, 18610, 33217, 21967, h1983, m1983, 38555 or 593. This allows a profile to be developed showing a battery of genes specifically expressed in one or more tissues.

In addition to such qualitative information, the invention allows the quantitation of gene expression. Thus, not only tissue specificity, but also the level of expression of a battery of genes in the tissue if ascertainable. Thus, genes can be grouped on the basis of their tissue expression per se and level of expression in that tissue. This is useful, for example, in ascertaining the relationship of gene expression in that tissue.

Thus, one tissue can be perturbed and the effect on gene expression in a second tissue can be determined. In this context, the effect of one cell type on another cell type in response to a biological stimulus can be determined. In this context, the effect of one cell type on another cell type in response to a biological stimulus can be determined. Such a determination is useful, for example, to know the effect of cell-cell interaction at the level of gene expression. If an agent is administered therapeutically to treat one cell type but has an undesirable effect on another cell type, the invention provides an assay to determine the molecular basis of the undesirable effect and thus provides the opportunity to co-administer a counteracting agent or otherwise treat the undesired effect. Similarly, even within a single cell type, undesirable biological effects can be determined at the molecular level. Thus, the effects of an agent on expression of other than the target gene can be ascertained and counteracted.

In another embodiment, the array can be used to monitor the time course of expression of one or more genes in the array. This can occur in various biological contexts, as disclosed herein, for example development of a guanylate kinase, phophatidylinositol 4-phosphate 5-kinase, kinase, transferase, aminopeptidase, adenylate cyclase, calpain protease, oxidoreductase, neprilysin protease, AMP binding enzyme or lysyl oxidase-associated or another 21910, 56634, 55053, 2504, 15977, 14760, 25501, 17903, 3700, 21529, 26176, 26343, 56638, 18610, 33217, 21967, h1983, m1983, 38555 or 593-associated disease or disorder, progression of a guanylate kinase, phophatidylinositol 4-phosphate 5-kinase, kinase, transferase, aminopeptidase, adenylate cyclase, calpain protease, oxidoreductase, neprilysin protease, AMP binding enzyme or lysyl oxidase-associated or another 21910, 56634, 55053, 2504, 15977, 14760, 25501, 17903, 3700, 21529, 26176, 26343, 56638, 18610, 33217, 21967, h1983, m1983, 38555 or 593-associated disease or disorder, and processes, such a cellular transformation associated with the guanylate kinase, phophatidylinositol 4-phosphate 5-kinase, kinase, transferase, aminopeptidase, adenylate cyclase, calpain protease, oxidoreductase, neprilysin protease, AMP binding enzyme or lysyl oxidase-associated or another 21910, 56634, 55053, 2504, 15977, 14760, 25501, 17903, 3700, 21529, 26176, 26343, 56638, 18610, 33217, 21967, h1983, m1983, 38555 or 593-associated disease or disorder.

The array is also useful for ascertaining the effect of the expression of a gene on the expression of other genes in the same cell or in different cells (e.g., ascertaining the effect of 21910, 56634, 55053, 2504, 15977, 14760, 25501, 17903, 3700, 21529, 26176, 26343, 56638, 18610, 33217, 21967, h1983, m1983, 38555 or 593 expression on the expression of other genes). This provides, for example, for a selection of alternate molecular targets for therapeutic intervention if the ultimate or downstream target cannot be regulated.

The array is also useful for ascertaining differential expression patterns of one or more genes in normal and abnormal cells. This provides a battery of genes (e.g., including 21910, 56634, 55053, 2504, 15977, 14760, 25501, 17903, 3700, 21529, 26176, 26343, 56638, 18610, 33217, 21967, h1983, m1983, 38555 or 593) that could serve as a molecular target for diagnosis or therapeutic intervention.

As used herein, a "target sequence" can be any DNA or amino acid sequence of six or more nucleotides or two or more amino acids. A skilled artisan can readily recognize that the longer a target sequence is, the less likely a target sequence will be present as a random occurrence in the database. Typical sequence lengths of a target sequence are from about 10 to 100 amino acids or from about 30 to 300 nucleotide residues. However, it is well recognized that commercially important fragments, such as sequence fragments involved in gene expression and protein processing, may be of shorter length.

Computer software is publicly available which allows a skilled artisan to access sequence information provided in a computer readable medium for analysis and comparison to other sequences. A variety of known algorithms are disclosed publicly and a variety of commercially available software for conducting search means are and can be used in the computer-based systems of the present invention. Examples of such software include, but are not limited to, MacPattern (EMBL), BLASTN and BLASTX (NCBI).

Thus, the invention features a method of making a computer readable record of a sequence of a 21910, 56634, 55053, 2504, 15977, 14760, 25501, 17903, 3700, 21529, 26176, 26343, 56638, 18610, 33217, 21967, h1983, m1983, 38555 or 593 sequence which includes recording the sequence on a computer readable matrix. In a preferred embodiment the record includes one or more of the following: identification of an ORF; identification of a domain, region, or site; identification of the start of transcription; identification of the transcription terminator; the full length amino acid sequence of the protein, or a mature form thereof; the 5' end of the translated region.

In another aspect, the invention features a method of analyzing a sequence. The method includes: providing a 21910, 56634, 55053, 2504, 15977, 14760, 25501, 17903, 3700, 21529, 26176, 26343, 56638, 18610, 33217, 21967, h1983, m1983, 38555 or 593 sequence, or record, in computer readable form; comparing a second sequence to the 21910, 56634, 55053, 2504, 15977, 14760, 25501, 17903, 3700, 21529, 26176, 26343, 56638, 18610, 33217, 21967, h1983, m1983, 38555 or 593 sequence; thereby analyzing a sequence. Comparison can include comparing to sequences for sequence identity or determining if one sequence is included within the other, e.g., determining if the 21910, 56634, 55053, 2504, 15977, 14760, 25501, 17903, 3700, 21529, 26176, 26343, 56638, 18610, 33217, 21967, h1983, m1983, 38555 or 593 sequence includes a sequence being compared. In a preferred embodiment the 21910, 56634, 55053, 2504, 15977, 14760, 25501, 17903, 3700, 21529, 26176, 26343, 56638, 18610, 33217, 21967, h1983, m1983, 38555 or 593 or second sequence is stored on a first computer, e.g., at a first site and the comparison is performed, read, or recorded on a second computer, e.g., at a second site. E.g., the 21910, 56634, 55053, 2504, 15977, 14760, 25501, 17903, 3700, 21529, 26176, 26343, 56638, 18610, 33217, 21967, h1983, m1983, 38555 or 593 or second sequence can be stored in a public or proprietary database in one computer, and the results of the comparison performed, read, or recorded on a second computer. In a preferred embodiment the record includes one or more of the following: identification of an ORF; identification of a domain, region, or site; identification of the start of transcription; identification of the transcription terminator; the full length amino acid sequence of the protein, or a mature form thereof; the 5' end of the translated region.

EXEMPLIFICATION

Example 1

Tissue Distribution of 21910, 56634, 55053, 2504, 15977, 14760, 25501, 17903, 3700, 21529, 26176, 26343, 56638, 18610, 33217, 21967, h1983, m1983, 38555 or 593 mRNA Northern blot hybridizations with various RNA samples can be performed under standard conditions and washed under stringent conditions, i.e., 0.2×SSC at 65° C. A DNA probe corresponding to all or a portion of the 21910, 56634, 55053, 2504, 15977, 14760, 25501, 17903, 3700, 21529, 26176, 26343, 56638, 18610, 33217, 21967, h1983, m1983, 38555 or 593 cDNA (SEQ ID NO: 1, 3, 5, 7, 10, 12, 18, 20, 21, 23, 24, 26, 31, 33, 39, 41, 43, 45, 46, 48, 49, 51, 54, 56, 57, 59, 63, 65, 66, 68, 71, 73, 88, 90, 104, 106, 107, 109, 111 or 113) or 21910, 56634, 55053, 2504, 15977, 14760, 25501, 17903, 3700, 21529, 26176, 26343, 56638, 18610, 33217, 21967, h1983, m1983, 38555 or 593 cDNA can be used. The DNA was radioactively labeled with $^{32}$P-dCTP using the Prime-It Kit (Stratagene, La Jolla, Calif.) according to the instructions of the supplier. Filters containing mRNA from mouse hematopoietic and endocrine tissues, and cancer cell lines (Clontech, Palo Alto, Calif.) can be probed in ExpressHyb hybridization solution (Clontech) and washed at high stringency according to manufacturer's recommendations.

Example 2

Recombinant Expression of 21910, 56634, 55053, 2504, 15977, 14760, 25501, 17903, 3700, 21529, 26176, 26343, 56638, 18610, 33217, 21967, h1983, m1983, 38555 or 593 in Bacterial Cells In this example, 21910, 56634, 55053, 2504, 15977, 14760, 25501, 17903, 3700, 21529, 26176, 26343, 56638, 18610, 33217, 21967, h1983, m1983, 38555 or 593 is expressed as a recombinant glutathione-S-transferase (GST) fusion polypeptide in *E. coli* and the fusion polypeptide is isolated and characterized. Specifically, 21910, 56634, 55053, 2504, 15977, 14760, 25501, 17903, 3700, 21529, 26176, 26343, 56638, 18610, 33217, 21967, h1983, m1983, 38555 or 593 is fused to GST and this fusion polypeptide is expressed in *E. coli*, e.g., strain PEB199. Expression of the GST-21910, -56634, -55053, -2504, -15977, -14760, -25501, -17903, -3700, -21529, -26176, -26343, -56638, -18610, -33217, -21967, -h1983, -m1983, -38555 or -593 fusion protein in PEB199 is induced with IPTG. The recombinant fusion polypeptide is purified from crude bacterial lysates of the induced PEB199 strain by affinity chromatography on glutathione beads. Using polyacrylamide gel electrophoretic analysis of the polypeptide purified from the bacterial lysates, the molecular weight of the resultant fusion polypeptide is determined.

Example 3

Expression of Recombinant 21910, 56634, 55053, 2504, 15977, 14760, 25501, 17903, 3700, 21529, 26176, 26343, 56638, 18610, 33217, 21967, h1983, m1983, 38555 or 593 Protein in COS Cells To express the 21910, 56634, 55053, 2504, 15977, 14760, 25501, 17903, 3700, 21529, 26176, 26343, 56638, 18610, 33217, 21967, h1983, m1983, 38555 or 593 gene in COS cells, the pcDNA/Amp vector by Invitrogen Corporation (San Diego, Calif.) is used. This vector contains an SV40 origin of replication, an ampicillin resistance gene, an E. coli replication origin, a CMV promoter followed by a polylinker region, and an SV40 intron and polyadenylation site. A DNA fragment encoding the entire 21910, 56634, 55053, 2504, 15977, 14760, 25501, 17903, 3700, 21529, 26176, 26343, 56638, 18610, 33217, 21967, h1983, m1983, 38555 or 593 protein and an HA tag (Wilson et al. (1984) Cell 37:767) or a FLAG tag fused in-frame to its 3' end of the fragment is cloned into the polylinker region of the vector, thereby placing the expression of the recombinant protein under the control of the CMV promoter.

To construct the plasmid, the 21910, 56634, 55053, 2504, 15977, 14760, 25501, 17903, 3700, 21529, 26176, 26343, 56638, 18610, 33217, 21967, h1983, m1983, 38555 or 593 DNA sequence is amplified by PCR using two primers. The 5' primer contains the restriction site of interest followed by approximately twenty nucleotides of the 21910, 56634, 55053, 2504, 15977, 14760, 25501, 17903, 3700, 21529, 26176, 26343, 56638, 18610, 33217, 21967, h1983, m1983, 38555 or 593 coding sequence starting from the initiation codon; the 3' end sequence contains complementary sequences to the other restriction site of interest, a translation stop codon, the HA tag or FLAG tag and the last 20 nucleotides of the 21910, 56634, 55053, 2504, 15977, 14760, 25501, 17903, 3700, 21529, 26176, 26343, 56638, 18610, 33217, 21967, h1983, m1983, 38555 or 593 coding sequence. The PCR amplified fragment and the pcDNA/Amp vector are digested with the appropriate restriction enzymes and the vector is dephosphorylated using the CIAP enzyme (New England Biolabs, Beverly, Mass.). Preferably the two restriction sites chosen are different so that the 21910, 56634, 55053, 2504, 15977, 14760, 25501, 17903, 3700, 21529, 26176, 26343, 56638, 18610, 33217, 21967, h1983, m1983, 38555 or 593 gene is inserted in the correct orientation. The ligation mixture is transformed into E. coli cells (strains HB101, DH5α, SURE, available from Stratagene Cloning Systems, La Jolla, Calif., can be used), the transformed culture is plated on ampicillin media plates, and resistant colonies are selected. Plasmid DNA is isolated from transformants and examined by restriction analysis for the presence of the correct fragment.

COS cells are subsequently transfected with the 21910-, 56634-, 55053-, 2504-, 15977-, 14760-, 25501-, 17903-, 3700-, 21529-, 26176-, 26343-, 56638-, 18610-, 33217-, 21967-, h1983-, m1983-, 38555- or 593-pcDNA/Amp plasmid DNA using the calcium phosphate or calcium chloride co-precipitation methods, DEAE-dextran-mediated transfection, lipofection, or electroporation. Other suitable methods for transfecting host cells can be found in Sambrook, J., Fritsh, E. F., and Maniatis, T. Molecular Cloning: A Laboratory Manual. 2nd, ed., Cold Spring Harbor Laboratory, Cold Spring Harbor Laboratory Press, Cold Spring Harbor, N.Y., 1989. The expression of the 21910, 56634, 55053, 2504, 15977, 14760, 25501, 17903, 3700, 21529, 26176, 26343, 56638, 18610, 33217, 21967, h1983, m1983, 38555 or 593 polypeptide is detected by radiolabelling ($^{35}$S-methionine or $^{35}$S-cysteine available from NEN, Boston, Mass., can be used) and immunoprecipitation (Harlow, E. and Lane, D. Antibodies: A Laboratory Manual, Cold Spring Harbor Laboratory Press, Cold Spring Harbor, N.Y., 1988) using an HA specific monoclonal antibody. Briefly, the cells are labeled for 8 hours with $^{35}$S-methionine (or $^{35}$S-cysteine). The culture media are then collected and the cells are lysed using detergents (RIPA buffer, 150 mM NaCl, 1% NP-40, 0.1% SDS, 0.5% DOC, 50 mM Tris, pH 7.5). Both the cell lysate and the culture media are precipitated with an HA specific monoclonal antibody. Precipitated polypeptides are then analyzed by SDS-PAGE.

Alternatively, DNA containing the 21910, 56634, 55053, 2504, 15977, 14760, 25501, 17903, 3700, 21529, 26176, 26343, 56638, 18610, 33217, 21967, h1983, m1983, 38555 or 593 coding sequence is cloned directly into the polylinker of the pcDNA/Amp vector using the appropriate restriction sites. The resulting plasmid is transfected into COS cells in the manner described above, and the expression of the 21910, 56634, 55053, 2504, 15977, 14760, 25501, 17903, 3700, 21529, 26176, 26343, 56638, 18610, 33217, 21967, h1983, m1983, 38555 or 593 polypeptide is detected by radiolabelling and immunoprecipitation using a 21910, 56634, 55053, 2504, 15977, 14760, 25501, 17903, 3700, 21529, 26176, 26343, 56638, 18610, 33217, 21967, h1983, m1983, 38555 or 593 specific monoclonal antibody.

Example 4

TaqMan Analysis of 21910, 56634, 55053, 2504, 15977, 14760, 25501, 17903, 3700, 21529, 26176, 26343, 56638, 18610, 33217, 21967, h1983, m1983, 38555 or 593

Human 21910, 56634, 55053, 2504, 15977, 14760, 25501, 17903, 3700, 21529, 26176, 26343, 56638, 18610, 33217, 21967, h1983, m1983, 38555 or 593 expression was measured by TaqMan® quantitative PCR (Perkin Elmer Applied Biosystems) in cDNA prepared from a variety of normal and diseased (e.g., cancerous) human tissues or cell lines.

Probes were designed by PrimerExpress software (PE Biosystems) based on the sequence of the human 21910, 56634, 55053, 2504, 15977, 14760, 25501, 17903, 3700, 21529, 26176, 26343, 56638, 18610, 33217, 21967, h1983, m1983, 38555 or 593 gene. Each human 21910, 56634, 55053, 2504, 15977, 14760, 25501, 17903, 3700, 21529, 26176, 26343, 56638, 18610, 33217, 21967, h1983, m1983, 38555 or 593 gene probe was labeled using FAM (6-carboxyfluorescein), and the β2-microglobulin reference probe was labeled with a different fluorescent dye, VIC. The differential labeling of the target gene and internal reference gene thus enabled measurement in same well. Forward and reverse primers and the probes for both β2-microglobulin and target gene were added to the TaqMan® Universal PCR Master Mix (PE Applied Biosystems). Although the final concentration of primer and probe could vary, each was internally consistent within a given experiment. A typical experiment contained 200 nM of forward and reverse primers plus 100 nM probe for β-2 microglobulin and 600 nM forward and reverse primers plus 200 nM probe for the target gene. TaqMan matrix experiments were carried out on an ABI PRISM 7700 Sequence Detection System (PE Applied Biosystems). The thermal cycler conditions were as follows: hold for 2 min at 50° C. and 10 min at 95° C., followed by two-step PCR for 40 cycles of 95° C. for 15 sec followed by 60° C. for 1 min.

The following method was used to quantitatively calculate human 21910, 56634, 55053, 2504, 15977, 14760, 25501, 17903, 3700, 21529, 26176, 26343, 56638, 18610, 33217, 21967, h1983, m1983, 38555 or 593 gene expression in the various tissues relative to β-2 microglobulin expression in the same tissue. The threshold cycle (Ct) value is defined as the cycle at which a statistically significant increase in fluorescence is detected. A lower Ct value is indicative of a higher mRNA concentration. The Ct value of the human 21910, 56634, 55053, 2504, 15977, 14760, 25501, 17903, 3700, 21529, 26176, 26343, 56638, 18610, 33217, 21967, h1983, m1983, 38555 or 593 gene is normalized by subtracting the Ct value of the β-2 microglobulin gene to obtain a $_\Delta Ct$ value using the following formula: $_\Delta Ct = Ct_{sample} - Ct_{\beta-2\ microglobulin}$. Expression is then calibrated against a cDNA sample showing a comparatively low level of expression of the human 21910, 56634, 55053, 2504, 15977, 14760, 25501, 17903, 3700, 21529, 26176, 26343, 56638, 18610, 33217, 21967, h1983, m1983, 38555 or 593 gene. The $_\Delta Ct$ value for the calibrator sample is then subtracted from $_\Delta Ct$ for each tissue sample according to the following formula: $_{\Delta\Delta}Ct = {_\Delta Ct}_{sample} - {_\Delta Ct}_{calibrator}$. Relative expression is then calculated using the arithmetic formula given by $2^{-\Delta\Delta Ct}$.

Example 5

In Situ Hybridization of 21910, 56634, 55053, 2504, 15977, 14760, 25501, 17903, 3700, 21529, 26176, 26343, 56638, 18610, 33217, 21967, h1983, m1983, 38555 or 593

The following describes the tissue distribution of 21910, 56634, 55053, 2504, 15977, 14760, 25501, 17903, 3700, 21529, 26176, 26343, 56638, 18610, 33217, 21967, h1983, m1983, 38555 or 593 mRNA, as may be determined by in situ hybridization analysis using oligonucleotide probes based on the human G2RF sequence.

For in situ analysis, various tissues, e.g. tissues obtained from brain, are first frozen on dry ice. Ten-micrometer-thick sections of the tissues are postfixed with 4% formaldehyde in DEPC treated 1× phosphate-buffered saline at room temperature for 10 minutes before being rinsed twice in DEPC 1× phosphate-buffered saline and once in 0.1 M triethanolamine-HCl (pH 8.0). Following incubation in 0.25% acetic anhydride-0.1 M triethanolamine-HCl for 10 minutes, sections are rinsed in DEPC 2×SSC (1×SSC is 0.15M NaCl plus 0.015M sodium citrate). Tissue is then dehydrated through a series of ethanol washes, incubated in 100% chloroform for 5 minutes, and then rinsed in 100% ethanol for 1 minute and 95% ethanol for 1 minute and allowed to air dry.

Hybridizations are performed with $^{35}$S-radiolabeled ($5 \times 10^7$ cpm/ml) cRNA probes. Probes are incubated in the presence of a solution containing 600 mM NaCl, 10 mM Tris (pH 7.5), 1 mM EDTA, 0.01% sheared salmon sperm DNA, 0.01% yeast tRNA, 0.05% yeast total RNA type X1, 1× Denhardt's solution, 50% formamide, 10% dextran sulfate, 100 mM dithiothreitol, 0.1% sodium dodecyl sulfate (SDS), and 0.1% sodium thiosulfate for 18 hours at 55° C.

After hybridization, slides are washed with 2×SSC. Sections are then sequentially incubated at 37° C. in TNE (a solution containing 10 mM Tris-HCl (pH 7.6), 500 mM NaCl, and 1 mM EDTA), for 10 minutes, in TNE with 10 µg of RNase A per ml for 30 minutes, and finally in TNE for 10 minutes. Slides are then rinsed with 2×SSC at room temperature, washed with 2×SSC at 50° C. for 1 hour, washed with 0.2×SSC at 55° C. for 1 hour, and 0.2×SSC at 60° C. for 1 hour. Sections are then dehydrated rapidly through serial ethanol-0.3 M sodium acetate concentrations before being air dried and exposed to Kodak Biomax MR scientific imaging film for 24 hours and subsequently dipped in NB-2 photoemulsion and exposed at 4° C. for 7 days before being developed and counter stained.

The contents of all references, patents and published patent applications cited throughout this application are incorporated herein by reference.

EQUIVALENTS

Those skilled in the art will recognize, or be able to ascertain using no more than routine experimentation, many equivalents to the specific embodiments of the invention described herein.

SEQUENCE LISTING (119 sequences)

SEQ ID NO: 1 - DNA, 4281 bp, Homo Sapiens
  CDS (452)...(2476)
  misc_feature (1)...(4281): n = A,T,C or G
agtaccccaaactttttactttcctactttgctaaactttccagtattgtatatcatttttcttagctttaaaattgaatagtatgtttcacatttttggaaagggactttggtggggaggggggaatcttgatttcctcaccattatctgtaaagtgaaagtacttaatctacttaacaaaataatattacatacttatgattttctacgttgtatggtgattagaagtgggctctgtaaaaacctgctttgatattgtgattcttacacttttgtgccccccatctttccccttagatttccttcatggatactttaccatagcattattatgtgatgtgagaagtttttccctctgaagtaacatggatttkatactacagaatcaagagaattggcttataggaaaaattgatttataaaaagtggtacaggttttcatagataaccatgacaacatcccatatgaatgggcatgttacagaggaatcagacagcgaagtaaaaaatgttgatcttgcatcaccagaggaacatcagaagcaccgagagatggctgttgactgccctggagatttgggcaccaggatgatgccaatacgtcgaagtgcacagttggagcgtattcggcaacaacaggaggacatgaggcgtaggagagaggaagaagggaaaaagcaagaacttgaccttaattcttccatgagacttaagaaactagcccaaattcctccaaagaccggaatagataaccctatgtttgatacagaggaaggaattgtcttagaaagtcctcattatgctgtgaaaatattagaaatagaagacttgttttcttcacttaaacatatccaacatactttggtagattctcagagccaggaggatatttcactgcttttacaacttgttcaaaataaggatttccagaatgcatttaagatacacaatgccatcacagtacacatgaacaaggccagtcctccatttcctcttatctccaacgcacaagatcttgctcaagaggtacaaactgttttgaagccagttcatcataaggaaggacaagaactaactgctttgctgaatactccacatattcaggcacttttactggcccacgataaggttgctgagcaggaaatgcagctagagcccattacagatgagagagtttatgaaagtattggccagtatggaggagaaactgtaaaaatagttcgtatagaaaaggctcgtgatattccgttgggtgctacagttcgtaatgaaatggactctgtcatcattagccggatagtaaaagggggtgctgcagagaaaagtggtctgttgcatgaaggagatgaagttctagagattaatggcattgaaattcgggggaaagatgtcaatgaggtttttgacttgttgtctgatatgcatggtactttgacttttgtcctgattcccagtcaacagatcaagccgcctcctgccaaggaaacagtaatccatgtaaaagctcattttgactatgacccctcagatgacccttatgttccatgtcgagagttaggtctgtcttttcaaaaaggtgatatacttcatgtgatcagtcaagaagatccaaactggtggcaggcctacagggaaggggacgaagataatcaacctctagccgggcttgttccagggaaaagctttcagcagcaaagggaagccatgaaacaaaccatagaagaagataaggagccagaaaaatcaggaaaactgtggtgtgcaaagaagaataaaaagaagaggaaaaaggttttatataatgccaataaaaatgatgattatgacaacgaggagatcttaacctatgaggaaatgtcactttatcatcagccagcaaataggaagagacctatcatcttgattggtccacagaactgtggccagaatgaattgcgtcagaggctcatgaacaaagaaaaggaccgctttgcatctgcagttcctcatacaacccggagtaggcgagaccaagaagtagccggtagagattaccactttgtttcgcggcaagcattcgaggcagacatagcagctggaaagttcattgagcatggtgaatttgagaagaatttgtatggaactagcatagattctgtacggcaagtgatcaactctggcaaaatatgtcttttaagtcttcgtacacagtcattgaagactctccggaattcagatttgaaaccatatattatcttcattgcacccccttcacaagaaagacttcgggcattattggccaaagaaggcaagaatccaaagcctgaagagttgagagaaatcattgagaagacaagagagatggagcagaacaatggccactactttgatacggcaattgtgaattccgatcttgataaagcctatcaggaattgcttaggttaattaacaaacttgatactgaacctcagtgggtaccatccacttggctgaggtgaaagaaacatccattctgtggcatgttggacttgatctggcaaaaactgccaataggaggactgcccgacactgcagcaagattgaggataagatggaaggcagcagtataagctgtagatctgttcttagatctcttgaattagtgagacgacagttcccttaggcagtttgtgcatggcatcctttattctctatacatggctttagcggttcttgcctcattttgggattctaaatggaagctttcaacagagcattccattttgtcctgttaaaaccttttgttttcacctaaaccctttctgcttagttgtatctctgtgaaaaacttgtatacacaagcgtccatgtctcacacaaatattgatgtgattattcttaagtgttaaatcattaacacttaaatgacttcattgggaatattgagcagagggactgtgcttctatgcactgggcaaggcagtatttgcttaggaaactaatttagtcatcagagatactttcctaaaaaggaaaaataaaaaacaaaatggtgccactttgggttgaagctactttgttaggcttgaattcatttatatgtcttttgattcttaaaaaaacaaaaaacattccattagaagcaccagtttttttgctcagactttgtggatcagactctacactcaacacactctaatctacttaaaggtatacaaaatatgctgatcttttttaaattatgatttcctgaatttttttcttaagtcgtctcaactgatttactcacttagcttcccttccctcatcagcatagtataatagaatgtatgttacatttttatgaatggcaggtgttcattataatctgtattgacttaaaaagtttcttcctcatgatgctaatagttttttgtatacatgggaggatagcacatttgacagtttttgcatttttatgtatgagcacagtatcctatgactgtgctacgtatatataggtaataaactggaattctgttgatgaatatagctgctgtactgtatattaatatttaatagatcaacaaatggtcattgaaaacacttgtttagcattagaataaaattatatatgtccttgggaaatattatgacagttgactttaagatcaaaaggaaaggaagacctgaaagtcatttgaacattttaggaaaagaatattggagagaaaaaggtattaaatatatagaaataggtttttaacctaacaaggtctgcctcttatgacgagaatgcaacagcttggtaaatcataaaagaaacatttaagctaataggattttcgtactgtctctatagctgtagctttaaaattcaacgtatataattggcatggaaacttaatttgcagtcttttcaagcctttaggatagtgtgatgtgtaacaaacaacctcaaatgtgaatgccttgattttatttttatggtgactttagctacagcatttcctatacccagagctaaacactggaataatactgacatcatttaatttaacataagcaattatgtttaaggagtaatttgtgtcatgtacatatttgattgattttttttcttctacataattttatttgaacaaatgtagacagtttatgtcgcctttttctgttcaaatttgcatggcctatnaagttggctggagagtgttttatgtggnaatattttcaagataatgttccttangaagnaaataacattnttgggttgagggaaggaatgccatacactactgtctcttcagatctgaaatactccagtttagagccaggaaatttc

SEQ ID NO: 2 - protein, 675 aa, Homo Sapiens
MTTSHMNGHVTEESDSEVKNVDLASPEEHQKHREMAVDCPGDLGTRMMPIRRSAQLERIRQQQEDMRRRREEEGKKQELDLNSSMRLKKLAQIPPKTGIDNPMFDTEEGIVLESPHYAVKILEIEDLFSSLKHIQHTLVDSQSQEDISLLLQLVQNKDFQNAFKIHNAITVHMNKASPPFPLISNAQDLAQEVQTVLKPVHHKEGQELTALLNTPHIQALLLAHDKVAEQEMQLEPITDERVYESIGQYGGETVKIVRIEKARDIPLGATVRNEMDSVIISRIVKGGAAEKSGLLHEGDEVLEINGIEIRGKDVNEVFDLLSDMHGTLTFVLIPSQQIKPPPAKETVIHVKAHFDYDPSDDPYVPCRELGLSFQKGDILHVISQEDPNWWQAYREGDEDNQPLAGLVPGKSFQQQREAMKQTIEEDKEPEKSGKLWCAKKNKKKRKKVLYNANKNDDYDNEEILTYEEMSLYHQPANRKRPIILIGPQNCGQNELRQRLMNKEKDRFASAVPHTTRSRRDQEVAGRDYHFVSRQAFEADIAAGKFIEHGEFEKNLYGTSIDSVRQVINSGKICLLSLRTQSLKTLRNSDLKPYIIFIAPPSQERLRALLAKEGKNPKPEELREIIEKTREMEQNNGHYFDTAIVNSDLDKAYQELLRLINKLDTEPQWVPSTWLR

SEQ ID NO: 3 - DNA, 2028 bp, Homo Sapiens
  CDS (1)...(2028)
atgacaacatcccatatgaatgggcatgttacagaggaatcagacagcgaagtaaaaaatgttgatcttgcatcaccagaggaacatcagaagcaccgagagatggctgttgactgccctggagatttgggcaccaggatgatgccaatacgtcgaagtgcacagttggagcgtattcggcaacaacaggaggacatgaggcgtaggagagaggaagaagggaaaaagcaagaacttgaccttaattcttccatgagacttaagaaactagcccaaattcctccaaagaccggaatagataaccctatgtttgatacagaggaaggaattgtcttagaaagtcctcattatgctgtgaaaatattagaaatagaagacttgttttcttcacttaaacatatccaacatactttggtagattctcagagccaggaggatatttcactgcttttacaacttgttcaaaataaggatttccagaatgcatttaagatacacaatgccatcacagtacacatgaacaaggccagtcctccatttcctcttatctccaacgcacaagatcttgctcaagaggtacaaactgttttgaagccagttcatcataaggaaggacaagaactaactgctttgctgaatactccacatattcaggcacttttactggcccacgataaggttgctgagcaggaaatgcagctagagcccattacagatgagagagtttatgaaagtattggccagtatggaggagaaactgtaaaaatagttcgtatagaaaaggctcgtgatattccgttgggtgctacagttcgtaatgaaatggactctgtcatcattagccggatagtaaaagggggtgctgcagagaaaagtggtctgttgcatgaaggagatgaagttctagagattaatggcattgaaattcgggggaaagatgtcaatgaggtttttgacttgttgtctgatatgcatggtactttgacttttgtcctgattcccagtcaacagatcaagccgcctcctgccaaggaaacagtaatccatgtaaaagctcattttgactatgacccctcagatgacccttatgttccatgtcgagagttaggtctgtcttttcaaaaaggtgatatacttcatgtgatcagtcaagaagatccaaactggtggcaggcctacagggaaggggacgaagataatcaacctctagccgggcttgttccagggaaaagctttcagcagcaaagggaagccatgaaacaaaccatagaagaagataaggagccagaaaaatcaggaaaactgtggtgtgcaaagaagaataaaaagaagaggaaaaaggttttatataatgccaataaaaatgatgattatgacaacgaggagatcttaacctatgaggaaatgtcactttatcatcagccagcaaataggaagagacctatcatcttgattggtccacagaactgtggccagaatgaattgcgtcagaggctcatgaacaaagaaaaggaccgctttgcatctgcagttcctcatacaacccggagtaggcgagaccaagaagtagccggtagagattaccactttgtttcgcggcaagcattcgaggcagacatagcagctggaaagttcattgagcatggtgaatttgagaagaatttgtatggaactagcatagattctgtacggcaagtgatcaactctggcaaaatatgtcttttaagtcttcgtacacagtcattgaagactctccggaattcagatttgaaaccatatattatcttcattgcacccccttcacaagaaagacttcgggcattattggccaaagaaggcaagaatccaaagcctgaagagttgagagaaatcattgagaagacaagagagatggagcagaacaatggccactactttgatacggcaattgtgaattccgatcttgataaagcctatcaggaattgcttaggttaattaacaaacttgatactgaacctcagtgggtaccatccacttggctgaggtga

SEQ ID NO: 4 - protein, 8 aa, Artificial Sequence
  Consensus Sequence
  VARIANT (1)...(1): Xaa = A or G
  VARIANT (2)...(5): Xaa = any amino acid
  VARIANT (8)...(8): Xaa = S or T
  VARIANT (1)...(8): Xaa = Any Amino Acid
XXXXXGKX

SEQ ID NO: 5 - DNA, 3224 bp, Homo Sapiens
  CDS (73)...(1335)
cgccgcttccggggtcgggcgcctggatagctgccggctccggcttccacttggtcggttgcgcgggagactatggcgtcctcctcggtcccaccagccacggtatcggcggcgacagcaggccccggcccaggtttcggcttcgcctccaagaccaagaagaagcatttcgtgcagcagaaggtgaaggtgttccgggcggccgacccgctggtgggtgtgttcctgtggggcgtagcccactcgatcaatgagctcagccaggtgcctcccccggtgatgctgctgccagatgactttaaggccagctccaagatcaaggtcaacaatcaccttttccacagggaaaatctgcccagtcatttcaagttcaaggagtattgtccccaggtcttcaggaacctccgtgatcgatttggcattgatgaccaagattacttggtgtcccttacccgaaacccccccagcgaaagtgaaggcagtgatggtcgcttccttatctcctacgatcggactctggtcatcaaagaagtatccagtgaggacattgctgacatgcatagcaacctctccaactatcaccagtacattgtgaagtgccatggcaacacgcttctgccccagttcctggggatgtaccgagtcagtgtggacaacgaagacagctacatgcttgtgatgcgcaatatgtttagccaccgtcttcctgtgcacaggaagtatgacctcaagggttccctagtgtcccgggaagccagcgataaggaaaaggttaaagaattgcccacccttaaggatatggactttctcaacaagaaccagaaagtatatattggtgaagaggagaagaaaatatttctggagaagctgaagagagatgtggagtttctagtgcagctgaagatcatggactacagccttctgctaggcatccacgacatcattcggggctctgaaccagaggaggaagcgcccgtgcgggaggatgagtcagaggtggatggggactgcagcctgactggacctcctgctctggtgggctcctatggcacctccccagagggtatcggaggctacatccattcccatcggcccctgggcccaggagagtttgagtccttcattgatgtctatgccatccggagtgctgaaggagccccccagaaggaggtctacttcatgggcctcattgatatccttacacagtatgatgccaagaagaaagcagctcatgcagccaaaactgtcaagcatggggctggggcagagatctctactgtccatccggagcagtatgctaagcgattcctggattttattaccaacatctttgcctaagagactgcctggttctctctgatgttcaaggtggtggggttctgagacacttgggggaattgtggggatattctagccaccagttctcttcttcctttgctaaattcaggctgcaggctccttccatccagataactccatcctgtcgagtaggctctttctgaccctcagaaatacattgtcctttttcctctttgcccatttttcttccctctcttcctccccatgagaagtctgcttgtagtattagaatgttattgttgactctctcccaagtgccttgatctttgtaatatctcctgttgtttctatgatataggagctaggggaagggggttgtttgccttcttcaggacctgactggacagatggacctggctcaagcaactactctggatgcactttgctgtgtgggatgaactaaaagtgtctgaattttgctgataactttataaaactcactatggcatgcttccctcctggtgggccctaggatggatgacactcaagatactacagatgtgggtgcaggcatgcacacacacgatggaatatggccattcctacacaggtggggtagagagtgggtcagcagcctggcacctcacagaggtgggacctaagaggactcatgattatgcagagaattggattgggtctctgtcatagattgagtaatctcttcccttacctcaattccatctccacccatctctacatctgggcacagcaacccagagatggccaaaagcattcaagcctgggggaagatgtttgactattgctgctcttcaccagaacctcacacctctcctgggactggaacccttcagtgggtgtgtggccagttttggaggctggaatgatgggccagggtgtaggattcattctccatgtaaagtttcctttcatcctgcctagccatccccaaggtttatttccagaagaaaggaatatctctacttggatcaattctggtcatttcaagaggatggaggcctcaagtgtgggaacttcccctactccctggatgtgtgtacctagcacacttccttctcccacccctttttccagttggatttgtttttctgttctcttctgtcctgtcttatactgcaactgtgtctcctaggggacagatggccttctttgtcatcttcactctccacccccagagaggagtcagagccataactcaatcactcagcccctccaaagatagttgatgtgtgataatctcataatgttgagaaccctgatgagatacattgtcttcctctccctacaatgcctctggggccaaggcacccattcttcttgctatcctccatcccccttgaggcttccactttttttttttttagacataaagctgggcatcagcaactggcctgtggtgatgcaaagctgctttgctctgtatctggctggactgatctgtctcacaagaagccatgaggccatagggagaagctccctctccccttcatcttctgctccaaaggtggtagcaagaggagtacccagttaggggttggagcccccatataacatcttcctgtcagaagactgatggatctttttcattccaaccatctccctttcccccgatgaatgcaataaaactctgtgacaccagcaaccattgctctttagaaatgggttttctgatcatatggctgatgtgttatgggcagtatggatgtcttcatttgttgcttctgtttttcatcttttttgttttattaataaaaatttatgtatttgctcctgttactataataatacagggaataaattattcaatccaaaaaaaaaaaaaaaaaaaaaaaaaaaaaaaaaaaaaaaaaaaaaaaaaaaaaaaaaaaaaaaaaaaaaaaaaaaaa

SEQ ID NO: 6 - protein, 421 aa, Homo Sapiens
MASSSVPPATVSAATAGPGPGFGFASKTKKKHFVQQKVKVFRAADPLVGVFLWGVAHSINELSQVPPPVMLLPDDFKASSKIKVNNHLFHRENLPSHFKFKEYCPQVFRNLRDRFGIDDQDYLVSLTRNPPSESEGSDGRFLISYDRTLVIKEVSSEDIADMHSNLSNYHQYIVKCHGNTLLPQFLGMYRVSVDNEDSYMLVMRNMFSHRLPVHRKYDLKGSLVSREASDKEKVKELPTLKDMDFLNKNQKVYIGEEEKKIFLEKLKRDVEFLVQLKIMDYSLLLGIHDIIRGSEPEEEAPVREDESEVDGDCSLTGPPALVGSYGTSPEGIGGYIHSHRPLGPGEFESFIDVYAIRSAEGAPQKEVYFMGLIDILTQYDAKKKAAHAAKTVKHGAGAEISTVHPEQYAKRFLDFITNIFA

SEQ ID NO: 7 - DNA, 1266 bp, Homo Sapiens
  CDS (1)...(1266)
atggcgtcctcctcggtcccaccagccacggtatcggcggcgacagcaggccccggcccaggtttcggcttcgcctccaagaccaagaagaagcatttcgtgcagcagaaggtgaaggtgttccgggcggccgacccgctggtgggtgtgttcctgtggggcgtagcccactcgatcaatgagctcagccaggtgcctcccccggtgatgctgctgccagatgactttaaggccagctccaagatcaaggtcaacaatcaccttttccacagggaaaatctgcccagtcatttcaagttcaaggagtattgtccccaggtcttcaggaacctccgtgatcgatttggcattgatgaccaagattacttggtgtcccttacccgaaacccccccagcgaaagtgaaggcagtgatggtcgcttccttatctcctacgatcggactctggtcatcaaagaagtatccagtgaggacattgctgacatgcatagcaacctctccaactatcaccagtacattgtgaagtgccatggcaacacgcttctgccccagttcctggggatgtaccgagtcagtgtggacaacgaagacagctacatgcttgtgatgcgcaatatgtttagccaccgtcttcctgtgcacaggaagtatgacctcaagggttccctagtgtcccgggaagccagcgataaggaaaaggttaaagaattgcccacccttaaggatatggactttctcaacaagaaccagaaagtatatattggtgaagaggagaagaaaatatttctggagaagctgaagagagatgtggagtttctagtgcagctgaagatcatggactacagccttctgctaggcatccacgacatcattcggggctctgaaccagaggaggaagcgcccgtgcgggaggatgagtcagaggtggatggggactgcagcctgactggacctcctgctctggtgggctcctatggcacctccccagagggtatcggaggctacatccattcccatcggcccctgggcccaggagagtttgagtccttcattgatgtctatgccatccggagtgctgaaggagccccccagaaggaggtctacttcatgggcctcattgatatccttacacagtatgatgccaagaagaaagcagctcatgcagccaaaactgtcaagcatggggctggggcagagatctctactgtccatccggagcagtatgctaagcgattcctggattttattaccaacatctttgcctaa

SEQ ID NO: 8 - protein, 359 aa, Artificial Sequence
  Consensus Sequence
VSLCSSPLLRELSSPGKSGSRFYLSQDDRFIIKTVQKSEVKVLLKMLPGYYEHINQNPGQKRNTLLPKFYGLYRVKVKGSFGNTEKKKKIRFVVMNNLFPSELKIHRKYDLKGSTVGREASKKEKKEEKELPTLKDLDFLEEGQKGLYLDSLKKKALLKQIKRDCEFLESLKIMDYSLLVGIHDLDRGCQGSEDKEEESILSKVEAEEGSDDSRPSKQGKTASASPDRSSVAMASCKPMRNSVVSEYSVTSTSVESILASFRNVERIEFGENIPAGGIRARREREEDGEESGASLENNEPEDLVLYIGIIDILQDYDLKKKLEHAWKSLQHDGGKGKTISVVNPEFYAKRFLDFMSKIF

SEQ ID NO: 9 - protein, 438 aa, Artificial Sequence
  Consensus Sequence
LPSDFKAKEKIKFPTPGSGLELTPSHGSADFKFKDYCPEVFRALREVLFGIDPADYLRSLCRSPLLLELSSGGKSGSFFYLSQDDRFIIKTLSKSEIKVLLKFAPMLPNYYEHVVQNPGNTLLPKFFGLYRVKVKGSTSNTGKKIRFLVMENLFYSELKIHRKYDLKGSTRGREASKDEAIKQKENTVLKDLDLVEEIYNQPIYVDPLAKKALLKQIKRDCEFLESLKIMDYSLLVGIHDKESGQREEIELEPNYSSDEESSSESSASLKQEKTASSSPDRSSTAMYSCVPSRDSVESESSVAIQSVTSSSARQALVSTSTASEDITGELLVSDETDIDVPFGGNIPARAIRAERRRVERKEIEDKEESATKEGENEAYDVVLYLGIIDILQTYTLDKKLEHAVKSIGHDGGKGKTISVVSPEQYSKRFRDFMDKYFL

SEQ ID NO: 10 - DNA, 2980 bp, Homo Sapiens
  CDS (86)...(2419)
gtcgacccacgcgtccgcggacgcgtgggcggacgcgtgggcggacgcgtggggggggaccggtcgggccgggaccaagggcaccatgtcgtccggggccaaggagggaggtgggggctctcccgcctaccacctcccccacccccacccccacccaccccagcacgcccaatatgtgggcccctatcggctggagaagacgctgggcaaaggacagacagggctggttaaactcggggtccactgcatcacgggtcagaaggtcgccatcaagatcgtgaaccgggagaagctgtcggagtcggtgctgatgaaggtggagcgggagatcgccatcctgaagctcatcgaacacccacatgtcctcaagctccacgacgtctacgagaacaagaaatatttgtacctggttctggagcacgtctcggggggtgagctattcgactacctggtaaagaaggggagactgacgcccaaggaggcccgaaagttcttccgccagattgtgtctgcgctggacttctgccacagctactccatctgccacagagacctaaagcccgagaacctgcttttggatgagaaaaacaacatccgcattgcagacttcggcatggcgtccctgcaggtgggggacagcctcctggagaccagctgcgggtccccccattatgcgtgtccagaggtgattaagggggaaaaatatgatggccgccgggcagacatgtggagctgtggagtcatcctcttcgccctgctcgtgggggctctgccctttgatgacgacaacctccgccagctgctggagaaggtgaaacggggcgtcttccacatgccccacttcattcctccagattgccagagcctcctgaggggaatgatcgaagtggagcccgaaaaaaggctcagtctggagcaaattcagaaacatccttggtacctaggcgggaaacacgagccagacccgtgcctggagccagcccctggccgccgggtagccatgcggagcctgccatccaacggagagctggaccccgacgtcctagagagcatggcatcactgggctgcttcagggaccgcgagaggctgcatcgcgagctgcgcagtgaggaggagaaccaagaaaagatgatatattatctgcttttggatcggaaggagcggtatcccagctgtgaggaccaggacctgcctccccggaatgatgttgaccccccccggaagcgtgtggattctcccatgctgagccgtcacgggaagcggcgaccagagcggaagtccatggaagtcctgagcatcaccgatgccgggggtggtggctcccctgtacccacccgacgggccttggagatggcccagcacagccagagatcccgtagcgtcagtggagcctccacgggtctgtcctccagccctctaagcagcccaaggagtccggtcttttccttttcaccggagccgggggctggagatgaggctcgaggcgggggctccccgacttccaaaacgcagacgctgccttctcggggccccaggggtgggggcgccggggagcagcccccgccccccagtgcccgctccacacccctgcccggccccccaggctccccgcgctcctctggcgggacccccttgcactcgcctctgcacacgccccgggccagtcccaccgggaccccggggacaacaccaccccccagccccggcggtggcgtcgggggagccgcctggaggagtcgtctcaactccatccgcaacagcttcctgggctcccctcgctttcaccggcgcaagatgcaggtccctaccgctgaggagatgtccagcttgacgccagagtcctccccggagctggcaaaacgctcctggttcgggaacttcatctccttggacaaagaagaacaaatattcctcgtgctaaaggacaaacctctcagcagcatcaaagcagacatcgtccatgcctttctgtcgatccccagcctgagtcacagtgtgctgtcacagaccagcttcagggccgagtacaaggccagtggcggcccctccgtcttccaaaagcccgtccgcttccaggtggacatcagctcctctgagggtccagagccctccccgcgacgggacggcagcggaggtggtggcatctactccgtcaccttcactctcatctcgggtcccagccgtcggttcaagcgagtggtggagaccatccaggcacagctcctgagcactcatgaccagccctccgtgcaggccctggcagacgagaagaacggggcccagacccggcctgctggtgccccaccccgaagcctgcagcccccacccggccgcccagacccagagctgagcagctctccccgccgaggcccccccaaggacaagaagctcctggccaccaacgggacccctctgccctgaccccacggggccggggagggaggggacccccctccaccccccttccgtgccccccaactgtgaatctgtaaataaggcccaaggaacatgtcgggaggggggtggacacaaaaaccggccttgccctgcagggatggggctccacaggccgtgcccaactgggggtggttctaggggaacagggggcgggggagctgtttctattttatttattgattaatttattattttatttattgatcaatctctctgcggggtggggtgggggagggacgggagctggttggggtggcttagcagatccggacagggccctctgtccctgtgtcgtccccaaccccctcttcccgggcccctcctcccctggtcctccccccacgaccttctgtacggatttgctctccggaaggaattctggtttcgcgtgatcctgcctgcgtccgtgtctctgattccgccggcggcaaaaaaaaaaaaaaaaaaaaaaaaaaaaaaagataataataataaatagccttgatcagggaaaaaaaaaaaaaaaaaaaagggcggccgcta

SEQ ID NO: 11 - protein, 778 aa, Homo Sapiens
MSSGAKEGGGGSPAYHLPHPHPHPPQHAQYVGPYRLEKTLGKGQTGLVKLGVHCITGQKVAIKIVNREKLSESVLMKVEREIAILKLIEHPHVLKLHDVYENKKYLYLVLEHVSGGELFDYLVKKGRLTPKEARKFFRQIVSALDFCHSYSICHRDLKPENLLLDEKNNIRIADFGMASLQVGDSLLETSCGSPHYACPEVIKGEKYDGRRADMWSCGVILFALLVGALPFDDDNLRQLLEKVKRGVFHMPHFIPPDCQSLLRGMIEVEPEKRLSLEQIQKHPWYLGGKHEPDPCLEPAPGRRVAMRSLPSNGELDPDVLESMASLGCFRDRERLHRELRSEEENQEKMIYYLLLDRKERYPSCEDQDLPPRNDVDPPRKRVDSPMLSRHGKRRPERKSMEVLSITDAGGGGSPVPTRRALEMAQHSQRSRSVSGASTGLSSSPLSSPRSPVFSFSPEPGAGDEARGGGSPTSKTQTLPSRGPRGGGAGEQPPPPSARSTPLPGPPGSPRSSGGTPLHSPLHTPRASPTGTPGTTPPPSPGGGVGGAAWRSRLNSIRNSFLGSPRFHRRKMQVPTAEEMSSLTPESSPELAKRSWFGNFISLDKEEQIFLVLKDKPLSSIKADIVHAFLSIPSLSHSVLSQTSFRAEYKASGGPSVFQKPVRFQVDISSSEGPEPSPRRDGSGGGGIYSVTFTLISGPSRRFKRVVETIQAQLLSTHDQPSVQALADEKNGAQTRPAGAPPRSLQPPPGRPDPELSSSPRRGPPKDKKLLATNGTPLP

SEQ ID NO: 12 - DNA, 2337 bp, Homo Sapiens
  CDS (1)...(2337)
atgtcgtccggggccaaggagggaggtgggggctctcccgcctaccacctcccccacccccacccccacccaccccagcacgcccaatatgtgggcccctatcggctggagaagacgctgggcaaaggacagacagggctggttaaactcggggtccactgcatcacgggtcagaaggtcgccatcaagatcgtgaaccgggagaagctgtcggagtcggtgctgatgaaggtggagcgggagatcgccatcctgaagctcatcgaacacccacatgtcctcaagctccacgacgtctacgagaacaagaaatatttgtacctggttctggagcacgtctcggggggtgagctattcgactacctggtaaagaaggggagactgacgcccaaggaggcccgaaagttcttccgccagattgtgtctgcgctggacttctgccacagctactccatctgccacagagacctaaagcccgagaacctgcttttggatgagaaaaacaacatccgcattgcagacttcggcatggcgtccctgcaggtgggggacagcctcctggagaccagctgcgggtccccccattatgcgtgtccagaggtgattaagggggaaaaatatgatggccgccgggcagacatgtggagctgtggagtcatcctcttcgccctgctcgtgggggctctgccctttgatgacgacaacctccgccagctgctggagaaggtgaaacggggcgtcttccacatgccccacttcattcctccagattgccagagcctcctgaggggaatgatcgaagtggagcccgaaaaaaggctcagtctggagcaaattcagaaacatccttggtacctaggcgggaaacacgagccagacccgtgcctggagccagcccctggccgccgggtagccatgcggagcctgccatccaacggagagctggaccccgacgtcctagagagcatggcatcactgggctgcttcagggaccgcgagaggctgcatcgcgagctgcgcagtgaggaggagaaccaagaaaagatgatatattatctgcttttggatcggaaggagcggtatcccagctgtgaggaccaggacctgcctccccggaatgatgttgaccccccccggaagcgtgtggattctcccatgctgagccgtcacgggaagcggcgaccagagcggaagtccatggaagtcctgagcatcaccgatgccgggggtggtggctcccctgtacccacccgacgggccttggagatggcccagcacagccagagatcccgtagcgtcagtggagcctccacgggtctgtcctccagccctctaagcagcccaaggagtccggtcttttccttttcaccggagccgggggctggagatgaggctcgaggcgggggctccccgacttccaaaacgcagacgctgccttctcggggccccaggggtgggggcgccggggagcagcccccgccccccagtgcccgctccacacccctgcccggccccccaggctccccgcgctcctctggcgggacccccttgcactcgcctctgcacacgccccgggccagtcccaccgggaccccggggacaacaccaccccccagccccggcggtggcgtcgggggagccgcctggaggagtcgtctcaactccatccgcaacagcttcctgggctcccctcgctttcaccggcgcaagatgcaggtccctaccgctgaggagatgtccagcttgacgccagagtcctccccggagctggcaaaacgctcctggttcgggaacttcatctccttggacaaagaagaacaaatattcctcgtgctaaaggacaaacctctcagcagcatcaaagcagacatcgtccatgcctttctgtcgatccccagcctgagtcacagtgtgctgtcacagaccagcttcagggccgagtacaaggccagtggcggcccctccgtcttccaaaagcccgtccgcttccaggtggacatcagctcctctgagggtccagagccctccccgcgacgggacggcagcggaggtggtggcatctactccgtcaccttcactctcatctcgggtcccagccgtcggttcaagcgagtggtggagaccatccaggcacagctcctgagcactcatgaccagccctccgtgcaggccctggcagacgagaagaacggggcccagacccggcctgctggtgccccaccccgaagcctgcagcccccacccggccgcccagacccagagctgagcagctctccccgccgaggcccccccaaggacaagaagctcctggccaccaacgggacccctctgccctga

SEQ ID NO: 13 - protein, 13 aa, Artificial Sequence
  Serine/threonine kinase signature motif consensus sequence
  VARIANT (1)...(1): Xaa = Leu, Ile, Val, Met, Phe, Tyr, or Cys
  VARIANT (2)...(2): Xaa = any amino acids
  VARIANT (3)...(3): Xaa = His or Tyr
  VARIANT (4)...(4): Xaa = any amino acids
  VARIANT (6)...(6): Xaa = Leu, Ile, Val, Met, Phe, or Tyr
  VARIANT (8)...(9): Xaa = any amino acids
  VARIANT (11)...(13): Xaa = Leu, Ile, Val, Met, Phe, Tyr, Cys, or Thr
XXXXDXKXXNXXX

SEQ ID NO: 14 - protein, 278 aa, Artificial Sequence
  Eukaryotic protein kinase domain
YELLEKLGEGSFGKVYKAKHKTGKIVAVKILKKESLSLREIQILKRLSHPNIVRLLGVFEDTDDHLYLVMEYMEGGDLFDYLRRNGPLSEKEAKKIALQILRGLEYLHSNGIVHRDLKPENILLDENGTVKIADFGLARLLEKLTTFVGTPWYMMAPEVILEGRGYSSKVDVWSLGVILYELLTGGPLFPGADLPAFTGGDEVDQLIIFVLKLPFSDELPKTRIDPLEELFRIKKRRLPLPSNCSEELKDLLKKCLNKDPSKRPGSATAKEILNHPWF

SEQ ID NO: 15 - protein, 41 aa, Artificial Sequence
  UBA domain
EDEEKIEQLVEMGFDREEVVKALRATNGNGVERAAEWLLSH

SEQ ID NO: 16 - protein, 231 aa, Artificial Sequence
  Serkin 6 domain
YELLKKLGKGAFGKVYLARDKKTGRLVAIKVIKERILREIKILKKDHPNIVKLYDVFEDDKLYLVMEYCEGDLGDLFDLLKKRGRRGLRKVLSEEARFYFRQILSALEYLHSQGIIHRDLKPENILLDSHVKLADFGLARQLTTFVGTPEYMAPEVLGYGKPAVDIWSLGCILYELLTGKPPFPQLDLIFKKIGSPEAKDLIKKLLVKDPEKRLTAEALEDELDIKAHPFF

SEQ ID NO: 17 - protein, 280 aa, Artificial Sequence
  Tyrkin 6 domain
LTLGKKLGEGAFGEVYKGTLKIEVAVKTLKEDAKEEFLREAKIMKKLGGKHPNIVKLLGVCTEEGRRFMEVEPLMIVMEYMEGGDLLDYLRKNRPKLSLSDLLSFALQIAKGMEYLESKNFVHRDLAARNCLVGENKVVKISDFGLSRDLYDDDKKGESKDYYRKKGGKGGKTLLPIRWMAPESLKDGKFTSKSDVWSFGVLLWEIFTLGEQPYPGEIQQFMSNEEVLEYLKKGYRLPKPENDLPISSVTCPDELYDLMLQCWAEDPEDRPTFSELVERL

SEQ ID NO: 18 - DNA, 2297 bp, Homo Sapiens
  CDS (154)...(1656)
  misc_feature (1)...(2297): n = A,T,C or G
cacgcgtccgcgaagcggctgcatctggcgccgcgtctgccccgcgtgctcggagcggattctgcccgccgtccccggagccctcggcgccccgctgagcccgcgatcacttcctccctgtgaccaaccggcgctgcaggttagagcctggcaatgccgtttgggtgtgtgactctgggcgacaagaagaactataaccagccatcggaggtgactgacagatatgatttgggacaggtcatcaagactgaggagttttgtgaaatcttccgggccaaggacaagacgacaggcaagctgcacacctgcaagaagttccagaagcgggacggccgcaaggtgcggaaagctgccaagaacgagataggcatcctcaagatggtgaagcatcccaacatcctacagctggtggatgtgtttgtgacccgcaaggagtactttatcttcctggagctggccacggggagggaggtgtttgactggatcctggaccagggctactactcggagcgagacacaagcaacgtggtacggcaagtcctggaggccgtggcctatttgcactcactcaagatcgtgcacaggaatctcaagctggagaacctggtttactacaaccggctgaagaactcgaagattgtcatcagtgacttccatctggctaagctagaaaatggcctcatcaaggagccctgtgggacccccgagtatctggccccagaggtggtaggccggcagcggtatggacgccctgtggactgctgggccattggagtcatcatgtacatcctgctttcaggcaatccacctttctatgaggaggtggaagaagatgattatgagaaccatgataagaatctcttccgcaagatcctggctggtgactatgagtttgactctccatattgggatgatatttcgcaggcagccaaagacctggtcacaaggctgatggaggtggagcaagaccagcggatcactgcagaagaggccatctcccatgagtggatttctggcaatgctgcttctgataagaacatcaaggatggtgtctgtgcccagattgaaaagaactttgccagggccaagtggaagaaggctgtccgagtgaccaccctcatgaaacggctccgggcaccagagcagtccagcacggctgcagcccagtcggcctcagccacagacactgccacccccggggctgcaggtggggccacagctgcagctgcgagtggagctacctcagcccctgagggtgatgctgctcgtgctgcaaagagtgataatgtggcccccgcagaccgtagtgccaccccagccacagatggaagtgccaccccagccactgatggcagtgtcaccccagccaccgatggaagcatcactccagccactgatgggagtgtcaccccagccactgacaggagcgctactccagccactgatgggagagccacaccagccacagaagagagcactgtgcccaccacccaaagcagtgccatgctggccaccaaggcagctgccacccctgagccggctatggcccagccggacagcacagccccagagggcgccacaggccaggctccaccctctagtaaaggggaagaggctgctggttatgcccaggagtctcaaagggaggaggccagctgagtaggcagcctggtgagggggggcaggggatgggcaggagggtgggagagtggatgaggggcttctcactgtacatagagtcactggcatgatgccctcgctcccccatgcccccacatcccagtggggcataactaggggtcacgggagagcagtctcgtctcctgtgtgtatgtgtgtgagtggtgggcaggccagtggcagggccggccccagcccctgcatggattccttgtggcttttctgtcttttgctagcttcaccagtttctgttccttgtgggatgctgctctagggatactcagggggctcctgctctccttccccttcccttcttgcctcaccattcccctaggcaggccctgcaggtcccacactctcccaggccctaaacttgggcggccttgccctgagagctggtcctccagcgaggccctgtcagcggtcttaggctcctgcacatgaaggtgtgtgcctgtggtgtgtgggctgctctaggagcagatacaggctggtatagaggatgcagaaaggtagggcagtatgtttaagtccagacttggcacatggctagggatactgctcactagctgtggaggtcctcaggagtggagagaatgagtagganggcagaanct

SEQ ID NO: 19 - protein, 501 aa, Homo Sapiens
MPFGCVTLGDKKNYNQPSEVTDRYDLGQVIKTEEFCEIFRAKDKTTGKLHTCKKFQKRDGRKVRKAAKNEIGILKMVKHPNILQLVDVFVTRKEYFIFLELATGREVFDWILDQGYYSERDTSNVVRQVLEAVAYLHSLKIVHRNLKLENLVYYNRLKNSKIVISDFHLAKLENGLIKEPCGTPEYLAPEVVGRQRYGRPVDCWAIGVIMYILLSGNPPFYEEVEEDDYENHDKNLFRKILAGDYEFDSPYWDDISQAAKDLVTRLMEVEQDQRITAEEAISHEWISGNAASDKNIKDGVCAQIEKNFARAKWKKAVRVTTLMKRLRAPEQSSTAAAQSASATDTATPGAAGGATAAAASGATSAPEGDAARAAKSDNVAPADRSATPATDGSATPATDGSVTPATDGSITPATDGSVTPATDRSATPATDGRATPATEESTVPTTQSSAMLATKAAATPEPAMAQPDSTAPEGATGQAPPSSKGEEAAGYAQESQREEAS

SEQ ID NO: 20 - DNA, 1506 bp, Homo Sapiens
  CDS (1)...(1506)
atgccgtttgggtgtgtgactctgggcgacaagaagaactataaccagccatcggaggtgactgacagatatgatttgggacaggtcatcaagactgaggagttttgtgaaatcttccgggccaaggacaagacgacaggcaagctgcacacctgcaagaagttccagaagcgggacggccgcaaggtgcggaaagctgccaagaacgagataggcatcctcaagatggtgaagcatcccaacatcctacagctggtggatgtgtttgtgacccgcaaggagtactttatcttcctggagctggccacggggagggaggtgtttgactggatcctggaccagggctactactcggagcgagacacaagcaacgtggtacggcaagtcctggaggccgtggcctatttgcactcactcaagatcgtgcacaggaatctcaagctggagaacctggtttactacaaccggctgaagaactcgaagattgtcatcagtgacttccatctggctaagctagaaaatggcctcatcaaggagccctgtgggacccccgagtatctggccccagaggtggtaggccggcagcggtatggacgccctgtggactgctgggccattggagtcatcatgtacatcctgctttcaggcaatccacctttctatgaggaggtggaagaagatgattatgagaaccatgataagaatctcttccgcaagatcctggctggtgactatgagtttgactctccatattgggatgatatttcgcaggcagccaaagacctggtcacaaggctgatggaggtggagcaagaccagcggatcactgcagaagaggccatctcccatgagtggatttctggcaatgctgcttctgataagaacatcaaggatggtgtctgtgcccagattgaaaagaactttgccagggccaagtggaagaaggctgtccgagtgaccaccctcatgaaacggctccgggcaccagagcagtccagcacggctgcagcccagtcggcctcagccacagacactgccacccccggggctgcaggtggggccacagctgcagctgcgagtggagctacctcagcccctgagggtgatgctgctcgtgctgcaaagagtgataatgtggcccccgcagaccgtagtgccaccccagccacagatggaagtgccaccccagccactgatggcagtgtcaccccagccaccgatggaagcatcactccagccactgatgggagtgtcaccccagccactgacaggagcgctactccagccactgatgggagagccacaccagccacagaagagagcactgtgcccaccacccaaagcagtgccatgctggccaccaaggcagctgccacccctgagccggctatggcccagccggacagcacagccccagagggcgccacaggccaggctccaccctctagtaaaggggaagaggctgctggttatgcccaggagtctcaaagggaggaggccagctga

SEQ ID NO: 21 - DNA, 4417 bp, Homo Sapiens
  CDS (337)...(1713)
gggagcgccccgcgtccgggacaagccgcagacaaaacccctcagacaccaaagggctttattcggccgggagcatcagcaaacttaggtctcaaaaaaccaagctctccaagttacaagatgttcacctaagattgagacctagtgactacgtttcctacgggaacaaataaatggtttttcatctcccggagatacattacaaacaaatatggtgctaaaagaactccttacctttctctgactacaatttatttggacatacttttgtattgaagagaggtatacatactgaagctacttgctgtactataggagactctgtcctgtaggatcatggaccatcctagtagggaaaaggatgaaagacaacggacaactaaacccatggcacaaaggagtgcacactgctctcgaccatctggctcctcatcgtcctctggggttcttatggtgggacccaacttcagggttggcaagaagataggatgtgggaacttcggagagctcagattaggtaaaaatctctacaccaatgaatatgtagcaatcaaactggaaccaataaaatcacgtgctccacagcttcatttagagtacagattttataaacagcttggcagtgcaggtgaaggtctcccacaggtgtattactttggaccatgtgggaaatataatgccatggtgctggagctccttggccctagcttggaggacttgtttgacctctgtgaccgaacatttactttgaagacggtgttaatgatagccatccagctgctttctcgaatggaatacgtgcactcaaagaacctcatttaccgagatgtcaagccagagaacttcctgattggtcgacaaggcaataagaaagagcatgttatacacattatagactttggactggccaaggaatacattgaccccgaaaccaaaaaacacataccttatagggaacacaaaagtttaactggaactgcgagatatatgtctatcaacacgcatcttggcaaagagcaaagccggagagatgatttggaagccctaggccatatgttcatgtatttccttcgaggcagcctcccctggcaaggactcaaggctgacacattaaaagagagatatcaaaaaattggtgacaccaaaaggaatactcccattgaagctctctgtgagaactttccagaggagatggcaacctaccttcgatatgtcaggcgactggacttctttgaaaaacctgattatgagtatttacggaccctcttcacagacctctttgaaaagaaaggctacacctttgactatgcctatgattgggttgggagacctattcctactccagtagggtcagttcacgtagattctggtgcatctgcaataactcgagaaagccacacacatagggatcggccatcacaacagcagcctcttcgaaatcagaatgtatcatcagagcgccgaggagagtgggaaattcagcccagccggcagaccaatacctcatacctaacgtctcacttggctgcagaccgccatgggggatcagtgcaggtggttagctcaaccaatggagagctgaatgttgatgatcccacgggagcccactccaatgcaccaatcacagctcatgccgaggtggaggtagtggaggaagctaagtgctgctgtttctttaagaggaaaaggaagaagactgctcagcgccacaagtgaccagtgcctcccaggagtcctcaggccctggggactctgactcaattgtacctgcagctcctgccatttctcattggaagggactcctctttgggggagggtggatatccaaaccaaaaagaagaaaacagatgcccccagaaggggccagtgcgggcagccagggcctagtgggtcattggccatctccgcctgcctaaggctctgagcaggtcccagagctgctgttcctccactgcttgcccatagggctgcctggttgactctccttcccattgtttacagtgaaggtgtcattcacaaaaactcaaggactgctattctccttcttccccttagtttactcctggtttttaccccaccctcaaccctctccagcataaaacctagtgagctaaaggctttgtctgcagaaggagatcaagaggctgggggtaaggccaagaaggtaggaggaaaatggcagacctgggctggagaagaaccttctccgtatcccaggtgtgcctggcagtatggtttcctcttcctctgtgcctgtgcagcattcatcccagctggccttggggttcaggttccttcttccctccctcctgtgaagttacactgtaggacacaagctgtgagcaatctgcagtctactgtccctgtgtgttggcgttcttagcttttttgacaaactcttttctccaggtagtaggacaatgaaaattgttctaagcaaaggaaagaaaactgactttgttgcacttttagtttttttaaaaaaaacaaaaacaaaaacatggcagatgcatattgtgtctggttatattgggggttttacttttacctgttttgagggggatggggccggccaagccattcagagagaacatgggtccagaggacattctcagtggaaagagtttgatctgcagcacccagaagagaagccaaactcggtgtcattctgagtgaacactcaggttggcaagaaaacatacttgaattttcattcatcttctcagcagctgaagaatgtccctaccagagcatcttgacctaatcagcttacagtttgaaaacctagctctccagaacatgagatgagccagccgagccagactgtgaccaggaaacagctcatcccagagaaggagatgcttaacaaaaaaaaattgaaattgtttcccatgctgccagggacttccaactagatagccatgtgacgtcctggtgacttgggggaaaaattagtgatgaaacagccaccaccatattgccattagtggaaaaaaagaggacagtgaacctgccttccacctgccagagggacctcagggtgtggcattatagggccaggaaaagaaaatcggtgtatcctatctgccccaatagctgagctgtagcatttgggctggcctgccttatcagaaaccaagcttatgaagatcttctcccagcaggtccatagcagtaggcttaggatgcagtatatggggccgcatttaaaaggagggaaagattgtttggtgctggaacattccagggaaaaggagactggaatgaaaggtctgaaattatcttctcaattggactccttccagaaaggtggccgtgcctctaagcatgtttttcccagtatgccctaggcctccccccatggtgttttcatatgaggtactactgtgaaggatctggttcctcattcactgtttgacaagtctttcatgtgtggagttactcttctcatgcccaattttcatttgagtttagtggcttaaccaaacaatgactcctcattccagcggtgacagaagagaaagggtcatttacatcaggaaagaggtcttgtatctgggagtagagagctaaccatggagcacagtggctggtgggtgacttagtctgatggtttgtggaccatagaagtcttcacctctggtttgaggtgcagggctgtcttttgtactggagggtgtggggatattttctgatagttgccatttcttgaaaaattcccttgatgtaccttacacagagcagaaataacattaacatggatcagaggtactgggcttcatctgttccattggaccttggctagggaatatcatttcactggcatcaaacctgcttagcttatgaaaagatggtaatatgtcatttctataaatgtttctatatatgaaacataaagtggcagggagatacaatatcacaccccttccccacaaggactgtgaatattgggatttatgtccttgccattacctagtggttacagccctatcactaaaatttacatcgtttctcagttgggatttgggcattgctaacttactgtatagaaagtttaacttttcctcacccctgtatagaaaatgccttgcctctcaagagagggcagagggggggccaggtgcagtggctcacgcctgtaatcccagcagtttgggaggccaaggcaagtggatcatgtgaggtcaagagttcgagaccagcctggccaacatggtgaaaccccgtctctacaaaaaatacaaaaattagctgggcatggtggcatgctcccgtagtcccagctactcggaggctgaggcaggagaatcacttgagcctgggaggcagaagttgcagtgagccgagatcgcaccactgcactccagcctgggcaacagagtgagactctgtctaaaaaaaaaaaaaaaaaagggcg

SEQ ID NO: 22 - protein, 459 aa, Homo Sapiens
MDHPSREKDERQRTTKPMAQRSAHCSRPSGSSSSSGVLMVGPNFRVGKKIGCGNFGELRLGKNLYTNEYVAIKLEPIKSRAPQLHLEYRFYKQLGSAGEGLPQVYYFGPCGKYNAMVLELLGPSLEDLFDLCDRTFTLKTVLMIAIQLLSRMEYVHSKNLIYRDVKPENFLIGRQGNKKEHVIHIIDFGLAKEYIDPETKKHIPYREHKSLTGTARYMSINTHLGKEQSRRDDLEALGHMFMYFLRGSLPWQGLKADTLKERYQKIGDTKRNTPIEALCENFPEEMATYLRYVRRLDFFEKPDYEYLRTLFTDLFEKKGYTFDYAYDWVGRPIPTPVGSVHVDSGASAITRESHTHRDRPSQQQPLRNQNVSSERRGEWEIQPSRQTNTSYLTSHLAADRHGGSVQVVSSTNGELNVDDPTGAHSNAPITAHAEVEVVEEAKCCCFFKRKRKKTAQRHK

SEQ ID NO: 23 - DNA, 1380 bp, Homo Sapiens
  CDS (1)...(1380)
atggaccatcctagtagggaaaaggatgaaagacaacggacaactaaacccatggcacaaaggagtgcacactgctctcgaccatctggctcctcatcgtcctctggggttcttatggtgggacccaacttcagggttggcaagaagataggatgtgggaacttcggagagctcagattaggtaaaaatctctacaccaatgaatatgtagcaatcaaactggaaccaataaaatcacgtgctccacagcttcatttagagtacagattttataaacagcttggcagtgcaggtgaaggtctcccacaggtgtattactttggaccatgtgggaaatataatgccatggtgctggagctccttggccctagcttggaggacttgtttgacctctgtgaccgaacatttactttgaagacggtgttaatgatagccatccagctgctttctcgaatggaatacgtgcactcaaagaacctcatttaccgagatgtcaagccagagaacttcctgattggtcgacaaggcaataagaaagagcatgttatacacattatagactttggactggccaaggaatacattgaccccgaaaccaaaaaacacataccttatagggaacacaaaagtttaactggaactgcgagatatatgtctatcaacacgcatcttggcaaagagcaaagccggagagatgatttggaagccctaggccatatgttcatgtatttccttcgaggcagcctcccctggcaaggactcaaggctgacacattaaaagagagatatcaaaaaattggtgacaccaaaaggaatactcccattgaagctctctgtgagaactttccagaggagatggcaacctaccttcgatatgtcaggcgactggacttctttgaaaaacctgattatgagtatttacggaccctcttcacagacctctttgaaaagaaaggctacacctttgactatgcctatgattgggttgggagacctattcctactccagtagggtcagttcacgtagattctggtgcatctgcaataactcgagaaagccacacacatagggatcggccatcacaacagcagcctcttcgaaatcagaatgtatcatcagagcgccgaggagagtgggaaattcagcccagccggcagaccaatacctcatacctaacgtctcacttggctgcagaccgccatgggggatcagtgcaggtggttagctcaaccaatggagagctgaatgttgatgatcccacgggagcccactccaatgcaccaatcacagctcatgccgaggtggaggtagtggaggaagctaagtgctgctgtttctttaagaggaaaaggaagaagactgctcagcgccacaagtga

SEQ ID NO: 24 - DNA, 2046 bp, Homo Sapiens
  CDS (119)...(1906)
  misc_feature (1)...(2046): n = A,T,C or G
ccacgcgtccgctgctcctgagcagccgctgggagacagacggcaaccaggttgcccctctttgctccagctagaaagacttgagttagacaagcagcagcacacgcctccctacctcatggcgacagaaaatggagcagttgagctgggaattcagaacccatcaacagacaaggcacctaaaggtcccacaggtgaaagacccctggctgcagggaaagaccctggccccccagacccaaagaaagctccggatccacccaccctgaagaaagatgccaaagcccctgcctcagagaaaggggatggtaccctggcccaaccctcaactagcagccaaggccccaaaggagagggtgacaggggcggggggcccgcggagggcagtgctgggcccccggcagccctgccccagcagactgcgacacctgagaccagcgtcaagaagcccaaggctgagcagggagcctcaggcagccaggatcctggaaagcccagggtgggcaagaaggcagcagagggccaagcagcagccaggaggggctcacctgcctttctgcatagccccagctgtcctgccatcatctccagttctgagaagctgctggccaagaagcccccaagcgaggcatcagagctcacctttgaaggggtgcccatgacccacagccccacggatcccaggccagccaaggcagaagaaggaaagaacatcctggcagagagccagaaggaagtgggagagaaaaccccaggccaggctggccaggctaagatgcaaggggacacctcgagggggattgagttccaggctgttccctcagagaaatccgaggtggggcaggccctctgtctcacagccagggaggaggactgcttccagattttggatgattgcccgccacctccggcccccttccctcaccgcatggtggagctgaggaccgggaatgtcagcagtgaattcagtatgaactccaaggaggcgctcggaggtggcaagtttggggcagtctgtacctgcatggagaaagccacaggcctcaagctggcagccaaggtcatcaagaaacagactcccaaagacaaggaaatggtgttgctggagattgaggtcatgaaccagctgaaccaccgcaatctgatccagctgtatgcagccatcgagactccgcatgagatcgtcctgttcatggagtacatcgagggcggagagctcttcgagaggattgtggatgaggactaccatctgaccgaggtggacaccatggtgtttgtcaggcagatctgtgacgggatcctcttcatgcacaagatgagggttttgcacctggacctcaagccagagaacatcctgtgtgtcaacaccaccgggcatttggtgaagatcattgactttggcctggcacggaggtataaccccaacgagaagctgaaggtgaactttgggaccccagagttcctgtcacctgaggtggtgaattatgaccaaatctccgataagacagacatgtggagtatgggggtgatcacctacatgctgctgagcggcctctcccccttcctgggagatgatgacacagagaccctaaacaacgttctatctggcaactggtactttgatgaagagacctttgaggccgtatcagacgaggccaaagactttgtctccaacctcatcgtcaaggaccagagggcccggatgaacgctgcccagtgtctcgcccatccctggctcaacaacctggcggagaaagccaaacgctgtaaccgacgccttaagtcccagatcttgcttaagaaatacctcatgaagaggcgctggaagaaaaacttcattgctgtcagcgctgccaaccgcttcaagaagatcagcagctcgggggcactgatggctctgggggtctgagccctgggcgcantggaaagcctggacgcagccacacagtggcgggggcttgaagccacacagcccagaaggccagaaaaggcagccagatccccagggcagcctcgttaggacaaggctgtgccaagggctgggaa

SEQ ID NO: 25 - protein, 596 aa, Homo Sapiens
MATENGAVELGIQNPSTDKAPKGPTGERPLAAGKDPGPPDPKKAPDPPTLKKDAKAPASEKGDGTLAQPSTSSQGPKGEGDRGGGPAEGSAGPPAALPQQTATPETSVKKPKAEQGASGSQDPGKPRVGKKAAEGQAAARRGSPAFLHSPSCPAIISSSEKLLAKKPPSEASELTFEGVPMTHSPTDPRPAKAEEGKNILAESQKEVGEKTPGQAGQAKMQGDTSRGIEFQAVPSEKSEVGQALCLTAREEDCFQILDDCPPPPAPFPHRMVELRTGNVSSEFSMNSKEALGGGKFGAVCTCMEKATGLKLAAKVIKKQTPKDKEMVLLEIEVMNQLNHRNLIQLYAAIETPHEIVLFMEYIEGGELFERIVDEDYHLTEVDTMVFVRQICDGILFMHKMRVLHLDLKPENILCVNTTGHLVKIIDFGLARRYNPNEKLKVNFGTPEFLSPEVVNYDQISDKTDMWSMGVITYMLLSGLSPFLGDDDTETLNNVLSGNWYFDEETFEAVSDEAKDFVSNLIVKDQRARMNAAQCLAHPWLNNLAEKAKRCNRRLKSQILLKKYLMKRRWKKNFIAVSAANRFKKISSSGALMALGV

SEQ ID NO: 26 - DNA, 1791 bp, Homo Sapiens
  CDS (1)...(1791)
atggcgacagaaaatggagcagttgagctgggaattcagaacccatcaacagacaaggcacctaaaggtcccacaggtgaaagacccctggctgcagggaaagaccctggccccccagacccaaagaaagctccggatccacccaccctgaagaaagatgccaaagcccctgcctcagagaaaggggatggtaccctggcccaaccctcaactagcagccaaggccccaaaggagagggtgacaggggcggggggcccgcggagggcagtgctgggcccccggcagccctgccccagcagactgcgacacctgagaccagcgtcaagaagcccaaggctgagcagggagcctcaggcagccaggatcctggaaagcccagggtgggcaagaaggcagcagagggccaagcagcagccaggaggggctcacctgcctttctgcatagccccagctgtcctgccatcatctccagttctgagaagctgctggccaagaagcccccaagcgaggcatcagagctcacctttgaaggggtgcccatgacccacagccccacggatcccaggccagccaaggcagaagaaggaaagaacatcctggcagagagccagaaggaagtgggagagaaaaccccaggccaggctggccaggctaagatgcaaggggacacctcgagggggattgagttccaggctgttccctcagagaaatccgaggtggggcaggccctctgtctcacagccagggaggaggactgcttccagattttggatgattgcccgccacctccggcccccttccctcaccgcatggtggagctgaggaccgggaatgtcagcagtgaattcagtatgaactccaaggaggcgctcggaggtggcaagtttggggcagtctgtacctgcatggagaaagccacaggcctcaagctggcagccaaggtcatcaagaaacagactcccaaagacaaggaaatggtgttgctggagattgaggtcatgaaccagctgaaccaccgcaatctgatccagctgtatgcagccatcgagactccgcatgagatcgtcctgttcatggagtacatcgagggcggagagctcttcgagaggattgtggatgaggactaccatctgaccgaggtggacaccatggtgtttgtcaggcagatctgtgacgggatcctcttcatgcacaagatgagggttttgcacctggacctcaagccagagaacatcctgtgtgtcaacaccaccgggcatttggtgaagatcattgactttggcctggcacggaggtataaccccaacgagaagctgaaggtgaactttgggaccccagagttcctgtcacctgaggtggtgaattatgaccaaatctccgataagacagacatgtggagtatgggggtgatcacctacatgctgctgagcggcctctcccccttcctgggagatgatgacacagagaccctaaacaacgttctatctggcaactggtactttgatgaagagacctttgaggccgtatcagacgaggccaaagactttgtctccaacctcatcgtcaaggaccagagggcccggatgaacgctgcccagtgtctcgcccatccctggctcaacaacctggcggagaaagccaaacgctgtaaccgacgccttaagtcccagatcttgcttaagaaatacctcatgaagaggcgctggaagaaaaacttcattgctgtcagcgctgccaaccgcttcaagaagatcagcagctcgggggcactgatggctctgggggtctga

SEQ ID NO: 27 - protein, 265 aa, Artificial Sequence
  Consensus Domain
KVYKAKHKTGKIVAVKILKKESLSLREIQILKRLSHPNIVRLLGVFEDTDDHLYLVMEYMEGGDLFDYLRRNGPLSEKEAKKIALQILRGLEYLHSNGIVHRDLKPENILLDENGTVKIADFGLARLLEKLTTFVGTPWYMMAPEVILEGRGYSSKVDVWSLGVILYELLTGGPLFPGADLPAFTGGDEVDQLIIFVLKLPFSDELPKTRIDPLEELFRIKKRRLPLPSNCSEELKDLLKKCLNKDPSKRPGSATAKEILNHPWF

SEQ ID NO: 28 - protein, 230 aa, Artificial Sequence
  Consensus Domain
YELLKKLGKGAFGKVYLARDKKTGRLVAIKVIKERILREIKILKKDHPNIVKLYDVFEDDKLYLVMEYCEGDLGDLFDLLKKRGRRGLRKVLSEEARFYFRQILSALEYLHSQGIIHRDLKPENILLDSVKLADFGLARQLTTFVGTPEYMAPEVLGYGKPAVDIWSLGCILYELLTGKPPFPQLDLIFKKIGSPEAKDLIKKLLVKDPEKRLTAEALEDELDIKAHPFF

SEQ ID NO: 29 - protein, 239 aa, Artificial Sequence
  Consensus Domain
YELLEKLGEGSFGKVYKAKHKTGKIVAVKILKKESLSLREIQILKRLSHPNIVRLLGVFEDTDDHLYLVMEYMEGGDLFDYLRRNGPLSEKEAKKIALQILRGLEYLHSNGIVHRDLKPENILLDENGTVKIADFGLARLLEKLTTFVGTPWYMMAPEVILEGRGYSSKVDVWSLGVILYELLTGGPLFPGADLPAFTGGDEVDQLIIFVLKLPFSDELPKTRIDPLEELFRIKKRRLP

SEQ ID NO: 30 - protein, 278 aa, Artificial Sequence; identical to SEQ ID NO: 14
  Consensus Domain

SEQ ID NO: 31 - DNA, 1971 bp, Homo Sapiens
  CDS (16)...(1527)
cgcgcctgagccgccatgtcggaggcgcgtggagagccagggtccgggcctgaggctggcgcccgattcttctgcactgcgggtcgcggcctggagccgttcgtaatgcgagaggtgcgggcgcggctggcggccacgcaggttgaatatatttcaggaaaggtttttttcaccacctgttctgatttgaatatgttgaagaaattaaaatctgcagaaagattatttttgctgattaaaaagcagtttccacttattatttcttctgtaagtaaaggaaaaatatttaatgaaatgcaaagacttataaatgaagatccaggaagttggttgaatgccatttcaatttggaaaaatcttcttgaacttgatgcaaaaaaggaaaaactttctcagagagatgataaccaactaaaaagaaaagtgggagaaaatgaaatcattgcaaagaaattaaaaatagaacaaatgcaaaagatagaagagaatagggactgccagctggaaaaacaaataaaagaagaaactctggagcaaagagattttaccactaaaagcgaaaagtttcaagaagaagaatttcagaatgacatagagaaagcaattgatactcataatcagaatgacttgactttcagagtatcttgtcgctgcagtggaactattggaaaggccttcactgcacaggaggtaggaaaagtaattggaattgctattatgaaacactttggatggaaagcagacttgaggaatccacaattagagatctttatacatctaaatgacatttactctgtggtggggattcctgtgttcagggtttccctagccagcagagcttacatcaagacagctggactgcgatctacaatagcgtgggcaatggcatctctggctgacattaaggctggtgcatttgttttagatccaatgtgtggacttggaacaatacttttggaagctgctaaagaatggccagatgtgtattatgtaggtgctgatgtcagcgactcacagttactaggtacttgggacaatctgaaagctgcaggccttgaggataaaattgaattacttaaaatctctgttatagaattgccattgccttcagaaagtgttgatattattatttctgacattccatttgggaaaaagtttaagttaggaaaagacatcaaaagcattctacaagaaatggaaagagtgcttcatgttggcggaaccattgtattgttgcttagtgaagatcaccacaggcgccttacagattgtaaagagagcaacatccctttcaattccaaggacagtcacacagatgaacctggaattaaaaagtgcttgaatcctgaagaaaaaactggtgcattcaagacagcgtcaacttcattcgaagccagtaaccacaaattcttagacagaatgtcaccatttggctccttggtaccagtggaatgctacaaagttagccttggaaagacagatgcgttcatatgtaaatataagaagtcgcactcttctggactgtagcaggcttgctgccatcagccgggttcaggcccttgtaagttagctgtacagcagaagtttgctgtctctaggattcatatagcacccacagagctccaagtaaccaaattcccccaaagacaggaggtgtggctgatgggtacacatgcttggtaagagtttctgctttatattctaaagtacttaatgtttttgagaaaaaagttaccgaatattttttagacttaagttttatcttctgtcagaatgtgaaaagttctgcccagtttctgagcaaaaacttcaatttcaaaataaaggttttcaggggttcacttaagtgtatcacaatcaacaccagacgggatattttaactatcagattttcggaaatgtaaaaacctttatgtgtaacttcttttgatattaaacttgatttttgagcctgtaaaaaaaaaaaaaaaa

SEQ ID NO: 32 - protein, 503 aa, Homo Sapiens
MSEARGEPGSGPEAGARFFCTAGRGLEPFVMREVRARLAATQVEYISGKVFFTTCSDLNMLKKLKSAERLFLLIKKQFPLIISSVSKGKIFNEMQRLINEDPGSWLNAISIWKNLLELDAKKEKLSQRDDNQLKRKVGENEIIAKKLKIEQMQKIEENRDCQLEKQIKEETLEQRDFTTKSEKFQEEEFQNDIEKAIDTHNQNDLTFRVSCRCSGTIGKAFTAQEVGKVIGIAIMKHFGWKADLRNPQLEIFIHLNDIYSVVGIPVFRVSLASRAYIKTAGLRSTIAWAMASLADIKAGAFVLDPMCGLGTILLEAAKEWPDVYYVGADVSDSQLLGTWDNLKAAGLEDKIELLKISVIELPLPSESVDIIISDIPFGKKFKLGKDIKSILQEMERVLHVGGTIVLLLSEDHHRRLTDCKESNIPFNSKDSHTDEPGIKKCLNPEEKTGAFKTASTSFEASNHKFLDRMSPFGSLVPVECYKVSLGKTDAFICKYKKSHSSGL

SEQ ID NO: 33 - DNA, 1512 bp, Homo Sapiens
  CDS (1)...(1512)
atgtcggaggcgcgtggagagccagggtccgggcctgaggctggcgcccgattcttctgcactgcgggtcgcggcctggagccgttcgtaatgcgagaggtgcgggcgcggctggcggccacgcaggttgaatatatttcaggaaaggtttttttcaccacctgttctgatttgaatatgttgaagaaattaaaatctgcagaaagattatttttgctgattaaaaagcagtttccacttattatttcttctgtaagtaaaggaaaaatatttaatgaaatgcaaagacttataaatgaagatccaggaagttggttgaatgccatttcaatttggaaaaatcttcttgaacttgatgcaaaaaaggaaaaactttctcagagagatgataaccaactaaaaagaaaagtgggagaaaatgaaatcattgcaaagaaattaaaaatagaacaaatgcaaaagatagaagagaatagggactgccagctggaaaaacaaataaaagaagaaactctggagcaaagagattttaccactaaaagcgaaaagtttcaagaagaagaatttcagaatgacatagagaaagcaattgatactcataatcagaatgacttgactttcagagtatcttgtcgctgcagtggaactattggaaaggccttcactgcacaggaggtaggaaaagtaattggaattgctattatgaaacactttggatggaaagcagacttgaggaatccacaattagagatctttatacatctaaatgacatttactctgtggtggggattcctgtgttcagggtttccctagccagcagagcttacatcaagacagctggactgcgatctacaatagcgtgggcaatggcatctctggctgacattaaggctggtgcatttgttttagatccaatgtgtggacttggaacaatacttttggaagctgctaaagaatggccagatgtgtattatgtaggtgctgatgtcagcgactcacagttactaggtacttgggacaatctgaaagctgcaggccttgaggataaaattgaattacttaaaatctctgttatagaattgccattgccttcagaaagtgttgatattattatttctgacattccatttgggaaaaagtttaagttaggaaaagacatcaaaagcattctacaagaaatggaaagagtgcttcatgttggcggaaccattgtattgttgcttagtgaagatcaccacaggcgccttacagattgtaaagagagcaacatccctttcaattccaaggacagtcacacagatgaacctggaattaaaaagtgcttgaatcctgaagaaaaaactggtgcattcaagacagcgtcaacttcattcgaagccagtaaccacaaattcttagacagaatgtcaccatttggctccttggtaccagtggaatgctacaaagttagccttggaaagacagatgcgttcatatgtaaatataagaagtcgcactcttctggactgtag

SEQ ID NO: 34 - protein, 133 aa, Artificial Sequence
  Consensus Domain
PKLARAMVNLARVKPGDTILDPFCGTGGFLIEAGLMGASRVIGTDIDWKMVRGARLNLEHYGVEDFVVYYGDANDLPLPFPDESVDAIATDPPYGRSTTTASEDLEELYRRSLESFHEVLKPHGWIAFAAPTD

SEQ ID NO: 35 - protein, 473 aa, Homo Sapiens
MREVRARLAATQVEYISGKVFFTTCSDLNMLKKLKSAERLFLLIKKQFPLIISSVSKGKIFNEMQRLINEDPGSWLNAISIWKNLLELDAKKEKLSQRDDNQLKRKVGENEIIAKKLKIEQMQKIEENRDCQLEKQIKEETLEQRDFTTKSEKFQEEEFQNDIEKAIDTHNQNDLTFRVSCRCSGTIGKAFTAQEVGKVIGIAIMKHFGWKADLRNPQLEIFIHLNDIYSVVGIPVFRVSLASRAYIKTAGLRSTIAWAMASLADIKAGAFVLDPMCGLGTILLEAAKEWPDVYYVGADVSDSQLLGTWDNLKAAGLEDKIELLKISVIELPLPSESVDIIISDIPFGKKFKLGKDIKSILQEMERVLHVGGTIVLLLSEDHHRRLTDCKESNIPFNSKDSHTDEPGIKKCLNPEEKTGAFKTASTSFEASNHKFLDRMSPFGSLVPVECYKVSLGKTDAFICKYKKSHSSGL

SEQ ID NO: 36 - protein, 12 aa, Artificial Sequence
  Consensus sequence
  VARIANT (3)...(3): Xaa = Leu, Ile, Val, Met, or Phe
  VARIANT (6)...(6): Xaa = Ser or Thr
  VARIANT (8)...(10): Xaa = Any Amino Acid
  VARIANT (11)...(11): Xaa = Leu or Ile
  VARIANT (1)...(12): Xaa = Any Amino Acid
DPXCGXGXXXXE

SEQ ID NO: 37 - protein, 7 aa, Artificial Sequence
  Consensus sequence
  VARIANT (1)...(1): Xaa  = Leu, Ile, Val, Met, Ala, or Cys
  VARIANT (2)...(2): Xaa = Leu, Ile, Val, Phe, Tyr, Trp, or Ala
  VARIANT (3)...(3): Xaa = Any Amino Acid
  VARIANT (4)...(4): Xaa = Asp or Asn
  VARIANT (7)...(7): Xaa = Phe, Tyr or Trp
XXXXPPX

SEQ ID NO: 38 - protein, 15 aa, Artificial Sequence
  Consensus sequence
  VARIANT (3)...(3): Xaa = Leu, Ile, Val, or Met
  VARIANT (5)...(5): Xaa = Pro or Val
  VARIANT (6)...(6): Xaa = Gly or Met
  VARIANT (8)...(8): Xaa = any amino acid
  VARIANT (9)...(9): Xaa = Leu, Ile, Val, Met, or Phe
  VARIANT (10)...(11): Xaa = any amino acid
  VARIANT (12)...(12): Xaa = Leu, Ile, Val, or Met
  VARIANT (14)...(14): Xaa = any amino acid
RVXKXXGXXXXXEXS

SEQ ID NO: 39 - DNA, 3034 bp, Homo Sapiens
  CDS (18)...(2195)
cacctagtgccggcggcatggcggcgcagtgctgctgccgccaggcgcccggcgccgaggccgcgcccgtccgcccgccgcccgagccgccgcccgccctggacgtggcctcggcctccagcgcgcagctcttccgcctccgccacctgcagctgggcctggagctgcggcccgaggcgcgcgagttggccggctgcctggtgctcgagctgtgcgcgctgcggcccgcgccccgcgcgctcgtgctcgacgcgcacccggctctgcgcctgcactcagccgccttccgtcgcgcccccgccgccgccgccgagacgccctgcgccttcgccttctccgcccccgggccggggcccgcgccgccgcccccgctgcccgccttccccgaggcgcccggctccgagcccgcctgctgtccgctggccttcagggtggacccgttcaccgactacggctcctcgctcaccgtcacgctgccgcccgagctgcaggcgcaccagcccttccaggtcatcctgcggtacacctcgaccgacgcccccgccatctggtggctggacccagagctgacctatggctgcgccaagcccttcgtcttcacccagggccactccgtgtgcaaccgctccttcttcccgtgcttcgacacacctgccgtgaagtgcacctactctgccgtcgtcaaggcgccatcgggggtgcaggtgctgatgagtgccacccggagtgcatacatggaggaagaaggcgtcttccacttccacatggagcaccccgtgcccgcctacctcgtggccctggtggccggagacctcaagccggcagacatcgggcccaggagccgcgtgtgggccgagccatgcctcctgcccacggccaccagcaagctgtcgggcgcagtggagcagtggctgagtgcagctgagcggctgtatgggccctacatgtggggcaggtacgacattgtcttcctgccaccctccttccccatcgtggccatggagaacccctgcctcaccttcatcatctcctccatcctggagagcgatgagttcctggtcatcgatgtcatccacgaggtggcccacagttggttcggcaacgctgtcaccaacgccacgtgggaagagatgtggctgagcgagggcctggccacctatgcccagcgccgtatcaccaccgagacctacggtgctgccttcacctgcctggagactgccttccgcctggacgccctgcaccggcagatgaagcttctgggagaggacagcccggtcagcaaactgcaggtcaagctggagccaggagtgaatcccagccacctgatgaacctgttcacctacgagaagggctactgcttcgtgtactacctgtcccagctctgcggagacccacagcgctttgatgactttctccgagcctatgtggagaagtacaagttcaccagcgtggtggcccaggacctgctggactccttcctgagcttcttcccggagctgaaggagcagagcgtggactgccgggcagggctggaattcgagcgctggctcaatgccacaggcccgccgctggctgagccggacctgtctcagggatccagcctgacccggcccgtggaggcccttttccagctgtggaccgcagaacctctggaccaggcagctgcctcggccagcgccattgacatctccaagtggaggaccttccagacagcactcttcctggaccggctcctggatgggtccccgctgccgcaggaggtggtgatgagcctgtccaagtgctactcctccctgctggactcgatgaacgctgagatccgcatccgctggctgcagattgtggtccgcaacgactactatcctgacctccacagggtgcggcgcttcctggagagccagatgtcacgcatgtacaccatcccgctgtacgaggacctctgcaccggtgccctcaagtccttcgcgctggaggtcttctaccagacgcagggccggctgcaccccaacctgcgcagagccatccagcagatcctgtcccagggcctgggctccagcacagagcccgcctcagagcccagcacggagctgggcaaggctgaagcagacacagactcggacgcacaggccctgctgcttggggacgaggcccccagcagtgccatctctctcagggacgtcaatgtgtctgcctagccctgttggcgggctgaccctcgacctcccagacaccacaattgtgccttctgtgggccaggcctgccatgactgcgtctcggctctggccatgagctctgcccaggcccacaagcccctcccctgggctctcccaggcagggagaatggggagagggacctccttgtgtctggcagagacctgtggacctggcctcccactccagctctcttgcactgcaagccctggggscaagcccgcacacaccatgccttctgtctcaacactgacagctgtgcctagccccggatgccagcacctgccaggtgccgccccggggcaagggccccagcagccctatggtgaccgccacacttgtgccttaatgtctgccgggggcccaggctgtgctgtccctgcagcacgcctccttgcagggatctgagccaccctccccgcacagccctgcaccccgcccctggggttggcagcctcagttggcccctggcagaggaacaaggacacagacattccctcagtgtggggggcaggggacacagggagaggatggttgtccctggggagggccctctggccccaggcaaccttagcccctcagaacagggagtcccaggacccagggagagtgtggggacaggacagcctgtctcttgtagcttcctggggtgggaggcacaggggcaaagcaataccccagggaaagtgggaggtggtgctggtgctctctccaggcccaccatgctgggagaggcggccagagcctggggcctccagcctgggactgctgtgatggggtatcacggtgatggtcccattaaacttccactctgcaaacctg

SEQ ID NO: 40 - protein, 725 aa, Homo Sapiens
MAAQCCCRQAPGAEAAPVRPPPEPPPALDVASASSAQLFRLRHLQLGLELRPEARELAGCLVLELCALRPAPRALVLDAHPALRLHSAAFRRAPAAAAETPCAFAFSAPGPGPAPPPPLPAFPEAPGSEPACCPLAFRVDPFTDYGSSLTVTLPPELQAHQPFQVILRYTSTDAPAIWWLDPELTYGCAKPFVFTQGHSVCNRSFFPCFDTPAVKCTYSAVVKAPSGVQVLMSATRSAYMEEEGVFHFHMEHPVPAYLVALVAGDLKPADIGPRSRVWAEPCLLPTATSKLSGAVEQWLSAAERLYGPYMWGRYDIVFLPPSFPIVAMENPCLTFIISSILESDEFLVIDVIHEVAHSWFGNAVTNATWEEMWLSEGLATYAQRRITTETYGAAFTCLETAFRLDALHRQMKLLGEDSPVSKLQVKLEPGVNPSHLMNLFTYEKGYCFVYYLSQLCGDPQRFDDFLRAYVEKYKFTSVVAQDLLDSFLSFFPELKEQSVDCRAGLEFERWLNATGPPLAEPDLSQGSSLTRPVEALFQLWTAEPLDQAAASASAIDISKWRTFQTALFLDRLLDGSPLPQEVVMSLSKCYSSLLDSMNAEIRIRWLQIVVRNDYYPDLHRVRRFLESQMSRMYTIPLYEDLCTGALKSFALEVFYQTQGRLHPNLRRAIQQILSQGLGSSTEPASEPSTELGKAEADTDSDAQALLLGDEAPSSAISLRDVNVSA

SEQ ID NO: 41 - DNA, 2178 bp, Homo Sapiens
  CDS (1)...(2178)
atggcggcgcagtgctgctgccgccaggcgcccggcgccgaggccgcgcccgtccgcccgccgcccgagccgccgcccgccctggacgtggcctcggcctccagcgcgcagctcttccgcctccgccacctgcagctgggcctggagctgcggcccgaggcgcgcgagttggccggctgcctggtgctcgagctgtgcgcgctgcggcccgcgccccgcgcgctcgtgctcgacgcgcacccggctctgcgcctgcactcagccgccttccgtcgcgcccccgccgccgccgccgagacgccctgcgccttcgccttctccgcccccgggccggggcccgcgccgccgcccccgctgcccgccttccccgaggcgcccggctccgagcccgcctgctgtccgctggccttcagggtggacccgttcaccgactacggctcctcgctcaccgtcacgctgccgcccgagctgcaggcgcaccagcccttccaggtcatcctgcggtacacctcgaccgacgcccccgccatctggtggctggacccagagctgacctatggctgcgccaagcccttcgtcttcacccagggccactccgtgtgcaaccgctccttcttcccgtgcttcgacacacctgccgtgaagtgcacctactctgccgtcgtcaaggcgccatcgggggtgcaggtgctgatgagtgccacccggagtgcatacatggaggaagaaggcgtcttccacttccacatggagcaccccgtgcccgcctacctcgtggccctggtggccggagacctcaagccggcagacatcgggcccaggagccgcgtgtgggccgagccatgcctcctgcccacggccaccagcaagctgtcgggcgcagtggagcagtggctgagtgcagctgagcggctgtatgggccctacatgtggggcaggtacgacattgtcttcctgccaccctccttccccatcgtggccatggagaacccctgcctcaccttcatcatctcctccatcctggagagcgatgagttcctggtcatcgatgtcatccacgaggtggcccacagttggttcggcaacgctgtcaccaacgccacgtgggaagagatgtggctgagcgagggcctggccacctatgcccagcgccgtatcaccaccgagacctacggtgctgccttcacctgcctggagactgccttccgcctggacgccctgcaccggcagatgaagcttctgggagaggacagcccggtcagcaaactgcaggtcaagctggagccaggagtgaatcccagccacctgatgaacctgttcacctacgagaagggctactgcttcgtgtactacctgtcccagctctgcggagacccacagcgctttgatgactttctccgagcctatgtggagaagtacaagttcaccagcgtggtggcccaggacctgctggactccttcctgagcttcttcccggagctgaaggagcagagcgtggactgccgggcagggctggaattcgagcgctggctcaatgccacaggcccgccgctggctgagccggacctgtctcagggatccagcctgacccggcccgtggaggcccttttccagctgtggaccgcagaacctctggaccaggcagctgcctcggccagcgccattgacatctccaagtggaggaccttccagacagcactcttcctggaccggctcctggatgggtccccgctgccgcaggaggtggtgatgagcctgtccaagtgctactcctccctgctggactcgatgaacgctgagatccgcatccgctggctgcagattgtggtccgcaacgactactatcctgacctccacagggtgcggcgcttcctggagagccagatgtcacgcatgtacaccatcccgctgtacgaggacctctgcaccggtgccctcaagtccttcgcgctggaggtcttctaccagacgcagggccggctgcaccccaacctgcgcagagccatccagcagatcctgtcccagggcctgggctccagcacagagcccgcctcagagcccagcacggagctgggcaaggctgaagcagacacagactcggacgcacaggccctgctgcttggggacgaggcccccagcagtgccatctctctcagggacgtcaatgtgtctgcctag

SEQ ID NO: 42 - protein, 281 aa, Artificial Sequence
  PFAM Peptidase M1 consensus sequence
TQFEEPTDARRAFPCFDEPSFKATFTITIIHPKGTTALSNMPEISTTKDDDGPTRVITTFETTPKMSTYLLAFIVGELEYIETETKDGYSAREVPVRVYARPGAKNAGQGQYALEVTKKLLEFYEEYFGIPYPLPKLDQVAVPDFSAGAMENWGLITYREPALLYDPRSSTNSDKQRVAEVIAHELAHQWFGNLVTMKWWDDLWLNEGFATYMEYLGTDELGGEPEWNIEAQFLLRDDVAQLALASDSLGSSHPITNKLVEVNTPAEISEIFDSAITYAKG

SEQ ID NO: 43 - DNA, 3353 bp, Homo Sapiens
  misc_feature (1)...(3353): n = A,T,C or G
cccacgcgtccgcccacgcgtccgcccacgcgtccgcccacgcgtccgggtactgctgtggctccccgtcctggtgcgggacctgtgccccgcgcttcagccctccccgcacagcctactgattcccctgccgcccttgctcacctcctgctcgccatggagtcgctggttttcgcgcggcgctccggccccactccctcggccgcagagctagcccggccgctggcggaagggctgatcaagtcgcccaagcccctaatgaagaagcaggcggtgaagcggcaccaccacaagcacaacctgcggcaccgctacgagttcctggagaccctgggcaaaggcacctacgggaaggtgaagaaggcgcgggagagctcggggcgcctggtggccatcaagtcaatccggaaggacaaaatcaaagatgagcaagatctgatgcacatacggagggagattgagatcatgtcatcactcaaccaccctcacatcattgccatccatgaagtgtttgagaacagcagcaagatcgtgatcgtcatggagtatgccagccggggcgacctttatgactacatcagcgagcggcagcagctcagtgagcgcgaagctaggcatttcttccggcagatcgtctctgccgtgcactattgccatcagaacagagttgtccaccgagatctcaagctggagaacatcctcttggatgccaatgggaatatcaagattgctgacttcggcctctccaacctctaccatcaaggcaagttcctgcagacattctgtgggagccccctctatgcctcgccagagattgtcaatgggaagccctacacaggcccagaggtggacagctggtccctgggtgttctcctctacatcctggtgcatggcaccatgccctttgatgggcatgaccataagatcctagtgaaacagatcagcaacggggcctaccgggagccacctaaaccctctgatgcctgtggcctgatccggtggctgttgatggtgaaccccacccgccgggccaccctggaggatgtggccagtcactggtgggtcaactggggctacgccacccgagtgggagagcaggaggctccgcatgagggtgggcaccctggcagtgactctgcccgcgcctccatggctgactggctccggcgttcctcccgccccctcctggagaatggggccaaggtgtgcagcttcttcaagcagcatgcacctggtgggggaagcaccacccctggcctggagcgccagcattcgctcaagaagtcccgcaaggagaatgacatggcccagtctctccacagtgacacggctgatgacactgcccatcgccctggcaagagcaacctcaagctgccaaagggcattctcaagaagaaggtgtcagcctctgcagaaggggtacaggaggaccctccggagctcagcccaatccctgcgagcccagggcaggctgcccccctgctccccaagaagggcattctcaagaagccccgacagcgcgagtctggctactactcctctcccgagcccagtgaatctggggagctcttggacgcaggcgacgtgtttgtgagtggggatcccaaggagcagaagcctccgcaagcttcagggctcctcctccatcgcaaaggcatcctcaaactcaatggcaagttctcccagacagccttagagctcgcggcccccaccaccttcggctccctggatgaactcgccccacctcgccccctggcccgggccagccgaccctcaggggctgtgagcgaggacagcatcctgtcctctgagtcctttgaccagctggacttgcctgaacggctcccagagcccccactgcggggctgtgtgtctgtggacaacctcacggggcttgaggagcccccctcagagggccctggaagctgcctgaggcgctggcggcaggatcctttgggggacagctgcttttccctgacagactgccaggaggtgacagcgacctaccgacaggcactgagggtctgctcaaagctcacctgagtggagtaggcattgccccagcccggtcaggctctcagatgcagctggttgcaccccgaggggagatgccttctcccccacctcccaggacctgcatcccagctcagaaggctgagagggtttgcagtggagccctgagcagggctggatatgggaagtaggcaaatgaaatgcgccaagggttcagtgtctgtcttcagccctgctgaacgaagaggatactaaagagaggggaacgggaatgcccgcgacagagtccacattgcctgtttcttgtgtacatgggggggccacagagacctggaaagagaactctcccagggcccatctcctgcatcccatgaatactctgtacacatggtgccttctaaggacagctccttccctactcattccctgcccaagtggggccagacctctttacacacacattcccgttcctaccaaccaccagaactggatggtggcacccctaatgtgcatgaggcatcctgggaatggtctggagtaacgcttcgttatttttatttttatttttatttatttatttatttttttgagacggagtttcgctcttggtgcccaggctagagtgcaatggcgcgatctcagctcacctcaacctccgcctcccgggttcaagcgattctcctgcctcagcctccctagtagctgggattacaggcgcccgccaccatgcccggctaattttgtatttttagtagagacagggtttctccatgttggtcaggctggtctcaaactcccgacctcaggtgatccacccacctcggcctcccaaagtgctgggattacaggcgtgagccaccgcgccccacctaacccttccttatttagcctaggagtaagagaacacaatctctgtttcttcaatggttctcttcccttttccatcctccaaacctggcctgagcctcctgaagttgctgctgtgaatctgaaagacttgaaaagcctccgcctgctgtgtggacttcatctcaaggggcccagcctcctctggactccaccttggacctcagtgactcagaacttctgcctctaagctgctctaaagtccagactatggatgtgttctctaggccttcaggactctagaatgtccatatttatttttatgttcttggctttgtgttttaggaaaagtgaatcttgctgttttcaataatgtgaatgctatgttctgggaaaaccccctttgccntntnaaaaaaaaaaaaaaaaaaaaaaaaaaaaaaaaaaaaaaaaaaaaaaaaaaaaaaaaaaaaaaaaaaaaaaaaaaaaaaagg

SEQ ID NO: 44 - protein, 628 aa, Homo Sapiens
MESLVFARRSGPTPSAAELARPLAEGLIKSPKPLMKKQAVKRHHHKHNLRHRYEFLETLGKGTYGKVKKARESSGRLVAIKSIRKDKIKDEQDLMHIRREIEIMSSLNHPHIIAIHEVFENSSKIVIVMEYASRGDLYDYISERQQLSEREARHFFRQIVSAVHYCHQNRVVHRDLKLENILLDANGNIKIADFGLSNLYHQGKFLQTFCGSPLYASPEIVNGKPYTGPEVDSWSLGVLLYILVHGTMPFDGHDHKILVKQISNGAYREPPKPSDACGLIRWLLMVNPTRRATLEDVASHWWVNWGYATRVGEQEAPHEGGHPGSDSARASMADWLRRSSRPLLENGAKVCSFFKQHAPGGGSTTPGLERQHSLKKSRKENDMAQSLHSDTADDTAHRPGKSNLKLPKGILKKKVSASAEGVQEDPPELSPIPASPGQAAPLLPKKGILKKPRQRESGYYSSPEPSESGELLDAGDVFVSGDPKEQKPPQASGLLLHRKGILKLNGKFSQTALELAAPTTFGSLDELAPPRPLARASRPSGAVSEDSILSSESFDQLDLPERLPEPPLRGCVSVDNLTGLEEPPSEGPGSCLRRWRQDPLGDSCFSLTDCQEVTATYRQALRVCSKLT

SEQ ID NO: 45 - DNA, 1884 bp, Homo Sapiens
atggagtcgctggttttcgcgcggcgctccggccccactccctcggccgcagagctagcccggccgctggcggaagggctgatcaagtcgcccaagcccctaatgaagaagcaggcggtgaagcggcaccaccacaagcacaacctgcggcaccgctacgagttcctggagaccctgggcaaaggcacctacgggaaggtgaagaaggcgcgggagagctcggggcgcctggtggccatcaagtcaatccggaaggacaaaatcaaagatgagcaagatctgatgcacatacggagggagattgagatcatgtcatcactcaaccaccctcacatcattgccatccatgaagtgtttgagaacagcagcaagatcgtgatcgtcatggagtatgccagccggggcgacctttatgactacatcagcgagcggcagcagctcagtgagcgcgaagctaggcatttcttccggcagatcgtctctgccgtgcactattgccatcagaacagagttgtccaccgagatctcaagctggagaacatcctcttggatgccaatgggaatatcaagattgctgacttcggcctctccaacctctaccatcaaggcaagttcctgcagacattctgtgggagccccctctatgcctcgccagagattgtcaatgggaagccctacacaggcccagaggtggacagctggtccctgggtgttctcctctacatcctggtgcatggcaccatgccctttgatgggcatgaccataagatcctagtgaaacagatcagcaacggggcctaccgggagccacctaaaccctctgatgcctgtggcctgatccggtggctgttgatggtgaaccccacccgccgggccaccctggaggatgtggccagtcactggtgggtcaactggggctacgccacccgagtgggagagcaggaggctccgcatgagggtgggcaccctggcagtgactctgcccgcgcctccatggctgactggctccggcgttcctcccgccccctcctggagaatggggccaaggtgtgcagcttcttcaagcagcatgcacctggtgggggaagcaccacccctggcctggagcgccagcattcgctcaagaagtcccgcaaggagaatgacatggcccagtctctccacagtgacacggctgatgacactgcccatcgccctggcaagagcaacctcaagctgccaaagggcattctcaagaagaaggtgtcagcctctgcagaaggggtacaggaggaccctccggagctcagcccaatccctgcgagcccagggcaggctgcccccctgctccccaagaagggcattctcaagaagccccgacagcgcgagtctggctactactcctctcccgagcccagtgaatctggggagctcttggacgcaggcgacgtgtttgtgagtggggatcccaaggagcagaagcctccgcaagcttcagggctcctcctccatcgcaaaggcatcctcaaactcaatggcaagttctcccagacagccttagagctcgcggcccccaccaccttcggctccctggatgaactcgccccacctcgccccctggcccgggccagccgaccctcaggggctgtgagcgaggacagcatcctgtcctctgagtcctttgaccagctggacttgcctgaacggctcccagagcccccactgcggggctgtgtgtctgtggacaacctcacggggcttgaggagcccccctcagagggccctggaagctgcctgaggcgctggcggcaggatcctttgggggacagctgcttttccctgacagactgccaggaggtgacagcgacctaccgacaggcactgagggtctgctcaaagctcacc

SEQ ID NO: 46 - DNA, 3518 bp, Homo Sapiens
  CDS (247)...(3480)
cttctacaatcggggtttgaggaagaagaagaaaaggactgaaggatcccttcatcgccagctggaagcgggcttgggagcccgcaaggagggcctgaaaaagaagacgggattgccacaaggttgggggcgcggggtggtacggctttgagcgggtgagaaaagctcaggtggggcccgccgggccgaaggaggtaacccggcgcccggccctagccagccccggggctcggggctggggagatcatggcccgcctcttcagcccccggccgccccccagcgaagacctcttctacgagacctactacagcctgagccagcagtacccgctgctgctgctgctgctggggatcgtgctctgtgcgctcgcggcgctgctcgcagtggcctgggccagcggcagggagctgacctcagacccgagcttcctgaccactgtgctgtgcgcgctgggcggcttctcgctgctgctgggcctcgcttcccgggagcagcgactgcagcgctggacgcgtcccctgtccggcttggtatgggtcgcgctgctagcgctaggccacgccttcctgttcaccgggggcgtggtgagcgcctgggaccaggtgtcctattttctcttcgtcatcttcacggcgtatgccatgctgcccttgggcatgcgggacgccgccgtcgcgggcctcgcctcctcactctcgcatctgctggtcctcgggctgtatcttgggccacagccggactcacggcctgcactgctgccgcagttggcagcaaacgcagtgctgttcctgtgcgggaacgtggcaggagtgtaccacaaggcgctgatggagcgcgccctgcgggccacgttccgggaggcactcagctccctgcactcacgccggcggctggacaccgagaagaagcaccaagaacaccttctcttgtccatccttcctgcctacctggcccgagagatgaaggcagagatcatggcacggctgcaggcaggacaggggtcacggccagagagcactaacaatttccacagcctctatgtcaagaggcaccagggagtcagcgtgctgtatgctgacatcgtgggcttcacgcggctggccagcgagtgttcccctaaggagctggtgctcatgctcaatgagctctttggcaagttcgaccagattgccaaggagcatgaatgcatgcggatcaagatcctgggggactgttactactgtgtctctgggctgccactctcactgccagaccatgccatcaactgcgtgcgcatgggcctggacatgtgccgggccatcaggaaactgcgggcagccactggcgtggacatcaacatgcgtgtgggcgtgcactcaggcagcgtactgtgtggagtcatcgggctgcagaagtggcagtacgacgtttggtcacatgatgtcacactggctaaccacatggaggcaggcggtgtaccagggcgagtgcacatcacaggggctaccctggccctgctggcaggggcttatgctgtggaggacgcaggcatggagcatcgggacccctaccttcgggagctaggggagcctacctatctggtcatcgatccacgggcagaggaggaggatgagaagggcactgcaggaggcttgctgtcctcgcttgagggcctcaagatgcgtccatcactgctgatgacccgttacctggagtcctggggggcagccaagccttttgcccacctgagccacggagacagccctgtgtccacctccacccctctcccggagaagaccctggcttccttcagcacccagtggagcctggatcggagccgtaccccccggggactagatgatgaactggacaccggggatgccaagttcttccaggtcattgagcagctcaactcgcagaaacagtggaagcagtcgaaggacttcaacccactgacactgtacttcagagagaaggagatggagaaagagtaccgactctctgcaatccccgccttcaaatactatgaagcctgcaccttcctggtttttctctccaacttcatcatccagatgctagtgacaaacaggcccccagctctggccatcacgtatagcatcactttcctcctcttcctcctcatcctttttgtctgcttctcagaggacctgatgaggtgtgtcctgaaaggccccaagatgctgcactggctgcctgcactgtctggcctggtggccacacgaccaggactgagaatagccttgggcaccgccaccatcctccttgtctttgccatggccattaccagcctgttcttcttcccaacatcatcagactgccctttccaagctcccaatgtgtcctccatgatttccaacctctcctgggagctccctgggtctctgcctctcatcagtgtcccatactccatgcactgctgcacgctgggcttcctctcctgctccctctttctgcacatgagcttcgagctgaagctgctgctgctcctgctgtggctggcggcatcctgctccctcttcctgcactcccatgcctggctgtcggaatgcctcatcgtccgcctctatctgggccccttggactccaggcccggagtgctgaaggagcccaaactgatgggtgctatctccttcttcatcttcttcttcaccctccttgtcctggctcgccagaatgagtactactgccgcctggacttcctgtggaagaagaagctgaggcaggagagggaggagacagagacgatggagaacctgactcggctgctcttggagaacgtgctccctgcacacgtggccccccagttcattggccagaaccggcgcaacgaggatctctaccaccagtcctatgaatgcgtttgtgtcctcttcgcctcagtcccagacttcaaggagttctactctgaatccaacatcaatcatgagggcctagagtgtctgaggctgctcaatgagataattgctgattttgatgagctgctctccaagcccaagttcagtggggtggagaagatcaagaccatcggcagcacctacatggcagccacaggcttaaatgccacctctggacaggatgcacaacaggatgctgaacggagctgcagccaccttggcactatggtggaatttgccgtggccctggggtctaagctggacgtcatcaacaagcattcattcaacaacttccgcctgcgagtggggttgaaccatggacccgtagtagctggagttattggggcccagaagccgcaatatgacatttggggcaacacagtgaacgtggccagccgcatggagagtacaggagtccttggcaaaatccaagtgactgaggagacagcatgggccctacagtccctgggctacacctgctacagccggggtgtcatcaaggtgaaaggcaaagggcagctctgcacctacttcctgaacacagacttgacacgaactggacctccttcagctaccctaggctgagattgcactcgccttctaagaacctcaataaagagact

SEQ ID NO: 47 - protein, 1077 aa, Homo Sapiens
MARLFSPRPPPSEDLFYETYYSLSQQYPLLLLLLGIVLCALAALLAVAWASGRELTSDPSFLTTVLCALGGFSLLLGLASREQRLQRWTRPLSGLVWVALLALGHAFLFTGGVVSAWDQVSYFLFVIFTAYAMLPLGMRDAAVAGLASSLSHLLVLGLYLGPQPDSRPALLPQLAANAVLFLCGNVAGVYHKALMERALRATFREALSSLHSRRRLDTEKKHQEHLLLSILPAYLAREMKAEIMARLQAGQGSRPESTNNFHSLYVKRHQGVSVLYADIVGFTRLASECSPKELVLMLNELFGKFDQIAKEHECMRIKILGDCYYCVSGLPLSLPDHAINCVRMGLDMCRAIRKLRAATGVDINMRVGVHSGSVLCGVIGLQKWQYDVWSHDVTLANHMEAGGVPGRVHITGATLALLAGAYAVEDAGMEHRDPYLRELGEPTYLVIDPRAEEEDEKGTAGGLLSSLEGLKMRPSLLMTRYLESWGAAKPFAHLSHGDSPVSTSTPLPEKTLASFSTQWSLDRSRTPRGLDDELDTGDAKFFQVIEQLNSQKQWKQSKDFNPLTLYFREKEMEKEYRLSAIPAFKYYEACTFLVFLSNFIIQMLVTNRPPALAITYSITFLLFLLILFVCFSEDLMRCVLKGPKMLHWLPALSGLVATRPGLRIALGTATILLVFAMAITSLFFFPTSSDCPFQAPNVSSMISNLSWELPGSLPLISVPYSMHCCTLGFLSCSLFLHMSFELKLLLLLLWLAASCSLFLHSHAWLSECLIVRLYLGPLDSRPGVLKEPKLMGAISFFIFFFTLLVLARQNEYYCRLDFLWKKKLRQEREETETMENLTRLLLENVLPAHVAPQFIGQNRRNEDLYHQSYECVCVLFASVPDFKEFYSESNINHEGLECLRLLNEIIADFDELLSKPKFSGVEKIKTIGSTYMAATGLNATSGQDAQQDAERSCSHLGTMVEFAVALGSKLDVINKHSFNNFRLRVGLNHGPVVAGVIGAQKPQYDIWGNTVNVASRMESTGVLGKIQVTEETAWALQSLGYTCYSRGVIKVKGKGQLCTYFLNTDLTRTGPPSATLG

SEQ ID NO: 48 - DNA, 3234 bp, Homo Sapiens
  CDS (1)...(3234)
atggcccgcctcttcagcccccggccgccccccagcgaagacctcttctacgagacctactacagcctgagccagcagtacccgctgctgctgctgctgctggggatcgtgctctgtgcgctcgcggcgctgctcgcagtggcctgggccagcggcagggagctgacctcagacccgagcttcctgaccactgtgctgtgcgcgctgggcggcttctcgctgctgctgggcctcgcttcccgggagcagcgactgcagcgctggacgcgtcccctgtccggcttggtatgggtcgcgctgctagcgctaggccacgccttcctgttcaccgggggcgtggtgagcgcctgggaccaggtgtcctattttctcttcgtcatcttcacggcgtatgccatgctgcccttgggcatgcgggacgccgccgtcgcgggcctcgcctcctcactctcgcatctgctggtcctcgggctgtatcttgggccacagccggactcacggcctgcactgctgccgcagttggcagcaaacgcagtgctgttcctgtgcgggaacgtggcaggagtgtaccacaaggcgctgatggagcgcgccctgcgggccacgttccgggaggcactcagctccctgcactcacgccggcggctggacaccgagaagaagcaccaagaacaccttctcttgtccatccttcctgcctacctggcccgagagatgaaggcagagatcatggcacggctgcaggcaggacaggggtcacggccagagagcactaacaatttccacagcctctatgtcaagaggcaccagggagtcagcgtgctgtatgctgacatcgtgggcttcacgcggctggccagcgagtgttcccctaaggagctggtgctcatgctcaatgagctctttggcaagttcgaccagattgccaaggagcatgaatgcatgcggatcaagatcctgggggactgttactactgtgtctctgggctgccactctcactgccagaccatgccatcaactgcgtgcgcatgggcctggacatgtgccgggccatcaggaaactgcgggcagccactggcgtggacatcaacatgcgtgtgggcgtgcactcaggcagcgtactgtgtggagtcatcgggctgcagaagtggcagtacgacgtttggtcacatgatgtcacactggctaaccacatggaggcaggcggtgtaccagggcgagtgcacatcacaggggctaccctggccctgctggcaggggcttatgctgtggaggacgcaggcatggagcatcgggacccctaccttcgggagctaggggagcctacctatctggtcatcgatccacgggcagaggaggaggatgagaagggcactgcaggaggcttgctgtcctcgcttgagggcctcaagatgcgtccatcactgctgatgacccgttacctggagtcctggggggcagccaagccttttgcccacctgagccacggagacagccctgtgtccacctccacccctctcccggagaagaccctggcttccttcagcacccagtggagcctggatcggagccgtaccccccggggactagatgatgaactggacaccggggatgccaagttcttccaggtcattgagcagctcaactcgcagaaacagtggaagcagtcgaaggacttcaacccactgacactgtacttcagagagaaggagatggagaaagagtaccgactctctgcaatccccgccttcaaatactatgaagcctgcaccttcctggtttttctctccaacttcatcatccagatgctagtgacaaacaggcccccagctctggccatcacgtatagcatcactttcctcctcttcctcctcatcctttttgtctgcttctcagaggacctgatgaggtgtgtcctgaaaggccccaagatgctgcactggctgcctgcactgtctggcctggtggccacacgaccaggactgagaatagccttgggcaccgccaccatcctccttgtctttgccatggccattaccagcctgttcttcttcccaacatcatcagactgccctttccaagctcccaatgtgtcctccatgatttccaacctctcctgggagctccctgggtctctgcctctcatcagtgtcccatactccatgcactgctgcacgctgggcttcctctcctgctccctctttctgcacatgagcttcgagctgaagctgctgctgctcctgctgtggctggcggcatcctgctccctcttcctgcactcccatgcctggctgtcggaatgcctcatcgtccgcctctatctgggccccttggactccaggcccggagtgctgaaggagcccaaactgatgggtgctatctccttcttcatcttcttcttcaccctccttgtcctggctcgccagaatgagtactactgccgcctggacttcctgtggaagaagaagctgaggcaggagagggaggagacagagacgatggagaacctgactcggctgctcttggagaacgtgctccctgcacacgtggccccccagttcattggccagaaccggcgcaacgaggatctctaccaccagtcctatgaatgcgtttgtgtcctcttcgcctcagtcccagacttcaaggagttctactctgaatccaacatcaatcatgagggcctagagtgtctgaggctgctcaatgagataattgctgattttgatgagctgctctccaagcccaagttcagtggggtggagaagatcaagaccatcggcagcacctacatggcagccacaggcttaaatgccacctctggacaggatgcacaacaggatgctgaacggagctgcagccaccttggcactatggtggaatttgccgtggccctggggtctaagctggacgtcatcaacaagcattcattcaacaacttccgcctgcgagtggggttgaaccatggacccgtagtagctggagttattggggcccagaagccgcaatatgacatttggggcaacacagtgaacgtggccagccgcatggagagtacaggagtccttggcaaaatccaagtgactgaggagacagcatgggccctacagtccctgggctacacctgctacagccggggtgtcatcaaggtgaaaggcaaagggcagctctgcacctacttcctgaacacagacttgacacgaactggacctccttcagctaccctaggctga

SEQ ID NO: 49 - DNA, 4398 bp, Homo Sapiens
  CDS (276)...(2714)
  misc_feature (1)...(4398): n = A,T,C or G
cncgcgtccgcggacgcgtgggggcgagggccgctggggccgcgaagtggggcggccgggtgggctacgagccgggtctgggctgaggggcgcggcttcgcggtggaccccagcccggcaacgggaaggcgagctctcctccaccgtccaaagtaaactttgccgctccttccgcggcgctcccgagtcctcgccgccgccgggccgccgcagtccgcgaagagccgtcctgcgtcagggcctccttccctgccccggcgcggggccactgcgccatggacgccacagcactggagcgggacgctgtgcagttcgcccgtctggcggttcagcgcgaccacgaaggccgctactccgaggcggtgttttattacaaggaagctgcacaagccttaatttatgctgagatggcaggatcaagcctagaaaatattcaagaaaaaataactgagtatctggaaagagttcaagctctacattcagcagttcagtcaaagagtgctgatcctttgaagtcaaaacatcagttggacttagagcgtgctcatttccttgttacacaagcttttgatgaagatgaaaaagagaatgttgaagatgctatagaattgtacacagaagctgtggatctctgtctgaaaacatcttatgaaactgctgataaagtcctgcaaaataaactgaaacagttggctcgacaggcactagacagagcagaagcgctgagtgagcctttgaccaagccagttggcaaaatcagttcaacaagtgttaagccaaagccacctccagtgagagcacattttccactgggcgctaatcccttccttgaaagacctcagtcatttataagtcctcagtcatgtgatgcacaaggacagagatacacagcagaagaaatagaagtactcaggacaacatcaaaaataaatggtatagaatatgttcctttcatgaatgttgacctgagagaacgttttgcctatccaatgcctttctgtgatagatggggcaagctaccattatcacctaaacaaaaaactacattttccaagtgggtacgaccagaagacctcaccaacaatcctacaatgatatatactgtgtccagttttagcataaagcagacaatagtatcggattgctcctttgtggcatcactggccatcagtgcagcttatgaaagacgttttaataagaagttaattaccggcataatttaccctcaaaacaaggatggtgaaccagaatacaatccatgtgggaagtatatggtaaaacttcacctcaatggtgtcccaagaaaggtgataattgatgaccagttacctgttgatcacaagggagaattgctctgttcttattccaacaacaaaagtgaattatgggtttctctcatagaaaaagcatacatgaaagtcatgggaggatatgattttccaggatccaactccaatattgatcttcatgcactgactggctggataccagaaagaattgctatgcattcagatagccaaactttcagtaaggataattctttcagaatgctttatcaaagatttcacaaaggagatgtcctcatcactgcgtcaactggaatgatgacagaagctgaaggagagaagtggggtctggttcccacacacgcatatgctgttttggatattagagagttcaaggggctgcgatttatccagttgaaaaatccttggagtcatttacgttggaaaggaagatacagtgaaaatgatgtaaaaaactggactccagagttgcaaaagtatttaaactttgatccccgaacagctcagaaaatagacaacggaatattttggatttcctgggatgatctctgccagtattatgatgtgatttatttgagttggaatccaggtctttttaaagaatcaacatgtattcacagtacttgggatgctaagcaaggacctgtgaaagatgcctatagcctggccaacaacccccagtacaaactggaggtgcagtgtccacaggggggtgctgcagtttgggttttgcttagtagacacataacagacaaggatgattttgcgaataatcgagaatttatcacaatggttgtatacaagactgatgggaaaaaagtttattacccagctgacccacctccatacattgatggaattcgaattaacagccctcattatttgactaagataaagctgaccacacctggcacccatacctttacattagtggtttctcaatatgaaaaacagaacacaatccattacacggttcgggtatattcagcatgcagctttactttttcaaagattccttcaccatacaccttatcaaaacggattaatggaaagtggagtggtcagagtgctggaggatgtggaaatttccaagagactcacaaaaataaccccatctaccaattccatatagaaaagactgggccgttactgattgagctacgaggaccaaggcaatatagcgttggatttgaggttgtaacagtttctactctaggagatcctggtccccatggctttctgaggaaatctagtggtgactataggtgtgggttttgctacctggaattagaaaatataccttctgggatcttcaatatcattcctagtacctttttgcctaaacaagaaggaccttttttcttggactttaatagtattatccccatcaagatcacacaacttcagtgatggagaaatctcaagttactggcttttatacttaccaaacatcagttcttcaaataaggacgcaaatcttcaggacagtaagcagaacaatcagaatggaattaaatctctaaaaacgtgttacagtggaatctggtgcttgtcagggtgtttggtaagaactgtatatagtcagaattacctaaatcacctagaggtaccgtttacatggttttgtgtatatagagttggcttgcattttaggggccattttgtataaaaagtgcatatgattaaaattagactcagtcatcactgtgagatgcctttgctaagaggataaaggaactgagaccagatgagaaaaagaaaggatatagattccttgagtggaatagtgggctagattaatataccgaaatatttccattgtttcccttttttgcagagcatgtggaagttaaacctgcttgattctactatacatcttgggcaactagttaccaaatgaattgtgccaccataactgattttaattttgcattatttatgattttaaaatatttgttgcccaggtgttatgaaagaataaagcttttaagtatagactaccttagcatgaagatgctcatgcctaagaatgaaaattgttgaggttatctcccattcaatcatgtagcaagaacttaaagaaattcactactgcagtttttatttttaaaaaaacagtaattgagatattgaagacattacaatttagtttgtgtggtctttttttaaattgctgtatcgttcagtctcttgtggcaatagcactttgaagaaaatagagaatttaatatatggtgattgggatatgtagcattcaaaaaaangtgaattgccaagatactggtgtcatgtaaattcccactttacataaaaacccatcaggacagaatgatgctcaatattttaaaattctaaaaatagggtgggatttttcattgtctctactttataattatcaaaacttattttgtattgctactaccttaaattgaaataaaatgtttatacttaaaaaaaaaaaaaaaaaaaaaagggcggccgctagactagtctagagaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatccccgggtaccgagctcgaattaattcctcttccgcttcctcgctcactgactcgctgcgctcggtcgttcggctgcggcgagcggtatcagctcactcaaaggcggtaatacggttatccacagaatcaggggataacgcaggaaanaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgctttaccggatacctgtccgcctttntccctttggggaagcggnggc

SEQ ID NO: 50 - protein, 813 aa, Homo Sapiens
MDATALERDAVQFARLAVQRDHEGRYSEAVFYYKEAAQALIYAEMAGSSLENIQEKITEYLERVQALHSAVQSKSADPLKSKHQLDLERAHFLVTQAFDEDEKENVEDAIELYTEAVDLCLKTSYETADKVLQNKLKQLARQALDRAEALSEPLTKPVGKISSTSVKPKPPPVRAHFPLGANPFLERPQSFISPQSCDAQGQRYTAEEIEVLRTTSKINGIEYVPFMNVDLRERFAYPMPFCDRWGKLPLSPKQKTTFSKWVRPEDLTNNPTMIYTVSSFSIKQTIVSDCSFVASLAISAAYERRFNKKLITGIIYPQNKDGEPEYNPCGKYMVKLHLNGVPRKVIIDDQLPVDHKGELLCSYSNNKSELWVSLIEKAYMKVMGGYDFPGSNSNIDLHALTGWIPERIAMHSDSQTFSKDNSFRMLYQRFHKGDVLITASTGMMTEAEGEKWGLVPTHAYAVLDIREFKGLRFIQLKNPWSHLRWKGRYSENDVKNWTPELQKYLNFDPRTAQKIDNGIFWISWDDLCQYYDVIYLSWNPGLFKESTCIHSTWDAKQGPVKDAYSLANNPQYKLEVQCPQGGAAVWVLLSRHITDKDDFANNREFITMVVYKTDGKKVYYPADPPPYIDGIRINSPHYLTKIKLTTPGTHTFTLVVSQYEKQNTIHYTVRVYSACSFTFSKIPSPYTLSKRINGKWSGQSAGGCGNFQETHKNNPIYQFHIEKTGPLLIELRGPRQYSVGFEVVTVSTLGDPGPHGFLRKSSGDYRCGFCYLELENIPSGIFNIIPSTFLPKQEGPFFLDFNSIIPIKITQLQ

SEQ ID NO: 51 - DNA, 2442 bp, Homo Sapiens
  CDS (1)...(2442)
atggacgccacagcactggagcgggacgctgtgcagttcgcccgtctggcggttcagcgcgaccacgaaggccgctactccgaggcggtgttttattacaaggaagctgcacaagccttaatttatgctgagatggcaggatcaagcctagaaaatattcaagaaaaaataactgagtatctggaaagagttcaagctctacattcagcagttcagtcaaagagtgctgatcctttgaagtcaaaacatcagttggacttagagcgtgctcatttccttgttacacaagcttttgatgaagatgaaaaagagaatgttgaagatgctatagaattgtacacagaagctgtggatctctgtctgaaaacatcttatgaaactgctgataaagtcctgcaaaataaactgaaacagttggctcgacaggcactagacagagcagaagcgctgagtgagcctttgaccaagccagttggcaaaatcagttcaacaagtgttaagccaaagccacctccagtgagagcacattttccactgggcgctaatcccttccttgaaagacctcagtcatttataagtcctcagtcatgtgatgcacaaggacagagatacacagcagaagaaatagaagtactcaggacaacatcaaaaataaatggtatagaatatgttcctttcatgaatgttgacctgagagaacgttttgcctatccaatgcctttctgtgatagatggggcaagctaccattatcacctaaacaaaaaactacattttccaagtgggtacgaccagaagacctcaccaacaatcctacaatgatatatactgtgtccagttttagcataaagcagacaatagtatcggattgctcctttgtggcatcactggccatcagtgcagcttatgaaagacgttttaataagaagttaattaccggcataatttaccctcaaaacaaggatggtgaaccagaatacaatccatgtgggaagtatatggtaaaacttcacctcaatggtgtcccaagaaaggtgataattgatgaccagttacctgttgatcacaagggagaattgctctgttcttattccaacaacaaaagtgaattatgggtttctctcatagaaaaagcatacatgaaagtcatgggaggatatgattttccaggatccaactccaatattgatcttcatgcactgactggctggataccagaaagaattgctatgcattcagatagccaaactttcagtaaggataattctttcagaatgctttatcaaagatttcacaaaggagatgtcctcatcactgcgtcaactggaatgatgacagaagctgaaggagagaagtggggtctggttcccacacacgcatatgctgttttggatattagagagttcaaggggctgcgatttatccagttgaaaaatccttggagtcatttacgttggaaaggaagatacagtgaaaatgatgtaaaaaactggactccagagttgcaaaagtatttaaactttgatccccgaacagctcagaaaatagacaacggaatattttggatttcctgggatgatctctgccagtattatgatgtgatttatttgagttggaatccaggtctttttaaagaatcaacatgtattcacagtacttgggatgctaagcaaggacctgtgaaagatgcctatagcctggccaacaacccccagtacaaactggaggtgcagtgtccacaggggggtgctgcagtttgggttttgcttagtagacacataacagacaaggatgattttgcgaataatcgagaatttatcacaatggttgtatacaagactgatgggaaaaaagtttattacccagctgacccacctccatacattgatggaattcgaattaacagccctcattatttgactaagataaagctgaccacacctggcacccatacctttacattagtggtttctcaatatgaaaaacagaacacaatccattacacggttcgggtatattcagcatgcagctttactttttcaaagattccttcaccatacaccttatcaaaacggattaatggaaagtggagtggtcagagtgctggaggatgtggaaatttccaagagactcacaaaaataaccccatctaccaattccatatagaaaagactgggccgttactgattgagctacgaggaccaaggcaatatagcgttggatttgaggttgtaacagtttctactctaggagatcctggtccccatggctttctgaggaaatctagtggtgactataggtgtgggttttgctacctggaattagaaaatataccttctgggatcttcaatatcattcctagtacctttttgcctaaacaagaaggaccttttttcttggactttaatagtattatccccatcaagatcacacaacttcagtga

SEQ ID NO: 52 - protein, 7 aa, Artificial Sequence
  Consensus sequence
  VARIANT (5)...(5): Xaa = Any amino acid
  VARIANT (1)...(7): Xaa = Any Amino Acid
TIPPXYR

SEQ ID NO: 53 - protein, 10 aa, Artificial Sequence
  Consensus sequence
  VARIANT (3)...(3): Xaa = Any amino acid
  VARIANT (8)...(8): Xaa = Any amino acid
  VARIANT (1)...(10): Xaa = Any Amino Acid
RPXKKKKXKP

SEQ ID NO: 54 - DNA, 2343 bp, Homo Sapiens
  CDS (253)...(2034)
  misc_feature (1)...(2343): n = A,T,C or G
gtcaccacgcgtccgggcgccggcgccgccggttaaagtgccgcggggcaggggccgggccgcggccacccgctcctcccgctccggtcccgactgycgggctctcggmcgmgtcgcccyggacaatcacaaagagtgtgtaggccagccccggtcacagagtgcaccgtatcctgtcacttctggatgtgagggagaagtgagtcatctcattcccctccgtggatcagaggacttggactagatagaagcatgtggtgtctcctacgaggcctgggccggcctggagccctggcacggggagccctggggcagcagcaatccctgggtgcccgggccctggccagcgcaggctctgagagccgggacgagtacagctatgtggtggtgggcgcgggctcggcgggctgcgtgctggctgggaggctcacggaggaccccgccgagcgcgtgctgctgctggaggccgggcccaaggacgtgcgcgcggggagcaagcggctctcgtggaagatccacatgcccgcggccctggtggccaacctgtgcgacgacaggtacaactggtgctaccacacagaggtgcagcggggcctggacggccgcgtgctgtactggccacgcggccgcgtctggggtggctcctcatccctcaatgccatggtctacgtccgtgggcacgccgaggactacgagcgctggcagcgccagggcgcccgcggctgggactacgcgcactgcctgccctacttccgcaaggcgcagggccacgagctgggcgccagccggtaccggggcgccgatggcccgctgcgggtgtcccggggcaagaccaaccacccgctgcactgcgcattcctggaggccacgcagcaggccggctacccgctcaccgaggacatgaatggcttccagcaggagggcttcggctggatggacatgaccatccatgaaggcaaacggtggagcgcagcctgtgcctacctgcacccagcactgagccgcaccaacctcaaggccgaggccgagacgcttgtgagcagggtgctatttgagggcacccgtgcagtgggcgtggagtatgtcaagaatggccagagccacagggcttatgccagcaaggaggtgattctgagtggaggtgccatcaactctccacagctgctcatgctctctggcatcgggaatgctgatgacctcaagaaactgggcatccctgtggtgtgccacctacctggggttggccagaacctgcaagaccacctggagatctacattcagcaggcatgcacccgccctatcaccctccattcagcacagaagcccctgcggaaggtctgcattggtctggagtggctctggaaattcacaggggtgggagccactgcccatctggaaacaggtgggttcatccgcagccagcctggggtcccccacccggacatccagttccatttcctgccatcccaagtgattgaccacgggcgggtccccacccagcaggaggcttaccaggtacatgtggggcccatgcggggcacgagtgtgggctggctcaaactgagaagtgccaatccccaagaccaccctgtgatccagcccaactacttgtcaacagaaactgatattgaggatttccgtctgtgtgtgaagctcaccagagaaatttttgcacaggaagccctggctccgttccgagggaaagagctccagccaggaagccacattcagtcagataaagagatagatgcctttgtgcgggcaaaagccgacagcgcctaccacccctcgtgcacctgtaagatgggccagccctccgatcccactgccgtggtggatccgcagacaagggtcctcggggtggaaaacctcagggtcgtcgatgcctccatcatgcctagcatggtcagcggcaacctgaacgcccccacaatcatgatcgcagagaaggcagctgacattatcaaggggcagcctgcactctgggacaaagatgtccctgtctacaagcccaggacgctggccacccagcgctaagacagttgctgctggaggatgaccagggaagccccctgataagccaagagggccagcacagcccttgctcccaggctcctgcctgaaactatctagcacactaggacccaggtggtaccctactcagtggctgagaattggataaagtcttgggaaatgagacaagtactgggcagtgaatccagctccttttccccagcctttccctgtgggccatttggggaaggccarcattcagcctgagatgtttccttccctgcctnctgggagggacagaaagggnaggtttggtttaattccttnccg

SEQ ID NO: 55 - protein, 594 aa, Homo Sapiens
MWCLLRGLGRPGALARGALGQQQSLGARALASAGSESRDEYSYVVVGAGSAGCVLAGRLTEDPAERVLLLEAGPKDVRAGSKRLSWKIHMPAALVANLCDDRYNWCYHTEVQRGLDGRVLYWPRGRVWGGSSSLNAMVYVRGHAEDYERWQRQGARGWDYAHCLPYFRKAQGHELGASRYRGADGPLRVSRGKTNHPLHCAFLEATQQAGYPLTEDMNGFQQEGFGWMDMTIHEGKRWSAACAYLHPALSRTNLKAEAETLVSRVLFEGTRAVGVEYVKNGQSHRAYASKEVILSGGAINSPQLLMLSGIGNADDLKKLGIPVVCHLPGVGQNLQDHLEIYIQQACTRPITLHSAQKPLRKVCIGLEWLWKFTGVGATAHLETGGFIRSQPGVPHPDIQFHFLPSQVIDHGRVPTQQEAYQVHVGPMRGTSVGWLKLRSANPQDHPVIQPNYLSTETDIEDFRLCVKLTREIFAQEALAPFRGKELQPGSHIQSDKEIDAFVRAKADSAYHPSCTCKMGQPSDPTAVVDPQTRVLGVENLRVVDASIMPSMVSGNLNAPTIMIAEKAADIIKGQPALWDKDVPVYKPRTLATQR

SEQ ID NO: 56 - DNA, 1785 bp, Homo Sapiens
  CDS (1)...(1785)
atgtggtgtctcctacgaggcctgggccggcctggagccctggcacggggagccctggggcagcagcaatccctgggtgcccgggccctggccagcgcaggctctgagagccgggacgagtacagctatgtggtggtgggcgcgggctcggcgggctgcgtgctggctgggaggctcacggaggaccccgccgagcgcgtgctgctgctggaggccgggcccaaggacgtgcgcgcggggagcaagcggctctcgtggaagatccacatgcccgcggccctggtggccaacctgtgcgacgacaggtacaactggtgctaccacacagaggtgcagcggggcctggacggccgcgtgctgtactggccacgcggccgcgtctggggtggctcctcatccctcaatgccatggtctacgtccgtgggcacgccgaggactacgagcgctggcagcgccagggcgcccgcggctgggactacgcgcactgcctgccctacttccgcaaggcgcagggccacgagctgggcgccagccggtaccggggcgccgatggcccgctgcgggtgtcccggggcaagaccaaccacccgctgcactgcgcattcctggaggccacgcagcaggccggctacccgctcaccgaggacatgaatggcttccagcaggagggcttcggctggatggacatgaccatccatgaaggcaaacggtggagcgcagcctgtgcctacctgcacccagcactgagccgcaccaacctcaaggccgaggccgagacgcttgtgagcagggtgctatttgagggcacccgtgcagtgggcgtggagtatgtcaagaatggccagagccacagggcttatgccagcaaggaggtgattctgagtggaggtgccatcaactctccacagctgctcatgctctctggcatcgggaatgctgatgacctcaagaaactgggcatccctgtggtgtgccacctacctggggttggccagaacctgcaagaccacctggagatctacattcagcaggcatgcacccgccctatcaccctccattcagcacagaagcccctgcggaaggtctgcattggtctggagtggctctggaaattcacaggggtgggagccactgcccatctggaaacaggtgggttcatccgcagccagcctggggtcccccacccggacatccagttccatttcctgccatcccaagtgattgaccacgggcgggtccccacccagcaggaggcttaccaggtacatgtggggcccatgcggggcacgagtgtgggctggctcaaactgagaagtgccaatccccaagaccaccctgtgatccagcccaactacttgtcaacagaaactgatattgaggatttccgtctgtgtgtgaagctcaccagagaaatttttgcacaggaagccctggctccgttccgagggaaagagctccagccaggaagccacattcagtcagataaagagatagatgcctttgtgcgggcaaaagccgacagcgcctaccacccctcgtgcacctgtaagatgggccagccctccgatcccactgccgtggtggatccgcagacaagggtcctcggggtggaaaacctcagggtcgtcgatgcctccatcatgcctagcatggtcagcggcaacctgaacgcccccacaatcatgatcgcagagaaggcagctgacattatcaaggggcagcctgcactctgggacaaagatgtccctgtctacaagcccaggacgctggccacccagcgctaa

SEQ ID NO: 57 - DNA, 2953 bp, Homo Sapiens
  CDS (212)...(2548)
cggacgcgtgggcggaagccttcaggcagcctcaactcagccccaagccactgctctcccatcccagtccctggaaatccacccacttggcccagctcaccccaactccaacccactgggacccagtctccaggggcctgactgtgggcggcagccactcctgagtgagcaaaggttcctccgcggtgctctcccgtccagagccctgctgatggggaagtccgaaggccccgtggggatggtggagagcgctggccgtgcagggcagaagcgcccggggttcctggagggggggctgctgctgctgctgctgctggtgaccgctgccctggtggccttgggtgtcctctacgccgaccgcagagggaagcagctgccacgccttgctagccggctgtgcttcttacaggaggagaggacctttgtaaaacgaaaaccccgagggatcccagaggcccaagaggtgagcgaggtctgcaccacccctggctgcgtgatagcagctgccaggatcctccagaacatggacccgaccacggaaccgtgtgacgacttctaccagtttgcatgcggaggctggctgcggcgccacgtgatccctgagaccaactcaagatacagcatctttgacgtcctccgcgacgagctggaggtcatcctcaaagcggtgctggagaattcgactgccaaggaccggccggctgtggagaaggccaggacgctgtaccgctcctgcatgaaccagagtgtgatagagaagcgaggctctcagcccctgctggacattttggaggtggtgggaggctggccggtggcgatggacaggtggaacgagaccgtaggactcgagtgggagctggagcggcagctggcgctgatgaactcacagttcaacaggcgcgtcctcatcgacctcttcatctggaacgacgaccagaactccagccggcacatcatctacatagaccagcccaccttgggcatgccctcccgagagtactacttcaacggcggcagcaaccggaaggtgcgggaagcctacctgcagttcatggtgtcagtggccacgttgctgcgggaggatgcaaacctgcccagggacagctgcctggtgcaggaggacatggtgcaggtgctggagctggagacacagctggccaaggccacggtaccccaggaggagagacacgacgtcatcgccttgtaccaccggatgggactggaggagctgcaaagccagtttggcctgaagggatttaactggactctgttcatacaaactgtgctatcctctgtcaaaatcaagctgctgccagatgaggaagtggtggtctatggcatcccctacctgcagaaccttgaaaacatcatcgacacctactcagccaggaccatacagaactacctggtctggcgcctggtgctggaccgcattggtagcctaagccagagattcaaggacacacgagtgaactaccgcaaggcgctgtttggcacaatggtggaggaggtgcgctggcgtgaatgtgtgggctacgtcaacagcaacatggagaacgccgtgggctccctctacgtcagggaggcgttccctggagacagcaagagcatggtcagagaactcattgacaaggtgcggacagtgtttgtggagacgctggacgagctgggctggatggacgaggagtccaagaagaaggcgcaggagaaggccatgagcatccgggagcagatcgggcaccctgactacatcctggaggagatgaacaggcgcctggacgaggagtactccaatctgaacttctcagaggacctgtactttgagaacagtctgcagaacctcaaggtgggcgcccagcggagcctcaggaagcttcgggaaaaggtggacccaaatctctggatcatcggggcggcggtggtcaatgcgttctactccccaaaccgaaaccagattgtattccctgccgggatcctccagccccccttcttcagcaaggagcagccacaggccttgaactttggaggcattgggatggtgatcgggcacgagatcacgcacggctttgacgacaatggccggaacttcgacaagaatggcaacatgatggattggtggagtaacttctccacccagcacttccgggagcagtcagagtgcatgatctaccagtacggcaactactcctgggacctggcagacgaacagaacgtgaacggattcaacacccttggggaaaacattgctgacaacggaggggtgcggcaagcctataaggcctacctcaagtggatggcagagggtggcaaggaccagcagctgcccggcctggatctcacccatgagcagctcttcttcatcaactatgcccaggtgtggtgcgggtcctaccggcccgagttcgccatccaatccatcaagacagacgtccacagtcccctgaagtacagggtactggggtcgctgcagaacctggccgccttcgcagacacgttccactgtgcccggggcacccccatgcaccccaaggagcgatgccgcgtgtggtagccaaggccctgccgcgctgtgcggcccacgcccacctgctgctcggaggcatctgtgcgaaggtgcagctagcggcgacccagtgtacgtcccgccccggccaaccatgccaagcctgcctgccaggcctctgcgcctggcctagggtgcagccacctgcctgacacccagggatgagcagtgtccagtgcagtacctggaccggagccccctccacagacacccgcggggctcagtgcccccgtcacagctctgtagagacaatcaactgtgtcctgcccaccctccaaggtgcattgtcttccagtatctacagcttcagacttgagctaagtaaatgcttcacagctatcaccatccttccgtgtttgaagcgtgaccgtgggatcctcaagagtcagc

SEQ ID NO: 58 - protein, 779 aa, Homo Sapiens
MGKSEGPVGMVESAGRAGQKRPGFLEGGLLLLLLLVTAALVALGVLYADRRGKQLPRLASRLCFLQEERTFVKRKPRGIPEAQEVSEVCTTPGCVIAAARILQNMDPTTEPCDDFYQFACGGWLRRHVIPETNSRYSIFDVLRDELEVILKAVLENSTAKDRPAVEKARTLYRSCMNQSVIEKRGSQPLLDILEVVGGWPVAMDRWNETVGLEWELERQLALMNSQFNRRVLIDLFIWNDDQNSSRHIIYIDQPTLGMPSREYYFNGGSNRKVREAYLQFMVSVATLLREDANLPRDSCLVQEDMVQVLELETQLAKATVPQEERHDVIALYHRMGLEELQSQFGLKGFNWTLFIQTVLSSVKIKLLPDEEVVVYGIPYLQNLENIIDTYSARTIQNYLVWRLVLDRIGSLSQRFKDTRVNYRKALFGTMVEEVRWRECVGYVNSNMENAVGSLYVREAFPGDSKSMVRELIDKVRTVFVETLDELGWMDEESKKKAQEKAMSIREQIGHPDYILEEMNRRLDEEYSNLNFSEDLYFENSLQNLKVGAQRSLRKLREKVDPNLWIIGAAVVNAFYSPNRNQIVFPAGILQPPFFSKEQPQALNFGGIGMVIGHEITHGFDDNGRNFDKNGNMMDWWSNFSTQHFREQSECMIYQYGNYSWDLADEQNVNGFNTLGENIADNGGVRQAYKAYLKWMAEGGKDQQLPGLDLTHEQLFFINYAQVWCGSYRPEFAIQSIKTDVHSPLKYRVLGSLQNLAAFADTFHCARGTPMHPKERCRVW

SEQ ID NO: 59 - DNA, 2340 bp, Homo Sapiens
  CDS (1)...(2340)
atggggaagtccgaaggccccgtggggatggtggagagcgctggccgtgcagggcagaagcgcccggggttcctggagggggggctgctgctgctgctgctgctggtgaccgctgccctggtggccttgggtgtcctctacgccgaccgcagagggaagcagctgccacgccttgctagccggctgtgcttcttacaggaggagaggacctttgtaaaacgaaaaccccgagggatcccagaggcccaagaggtgagcgaggtctgcaccacccctggctgcgtgatagcagctgccaggatcctccagaacatggacccgaccacggaaccgtgtgacgacttctaccagtttgcatgcggaggctggctgcggcgccacgtgatccctgagaccaactcaagatacagcatctttgacgtcctccgcgacgagctggaggtcatcctcaaagcggtgctggagaattcgactgccaaggaccggccggctgtggagaaggccaggacgctgtaccgctcctgcatgaaccagagtgtgatagagaagcgaggctctcagcccctgctggacattttggaggtggtgggaggctggccggtggcgatggacaggtggaacgagaccgtaggactcgagtgggagctggagcggcagctggcgctgatgaactcacagttcaacaggcgcgtcctcatcgacctcttcatctggaacgacgaccagaactccagccggcacatcatctacatagaccagcccaccttgggcatgccctcccgagagtactacttcaacggcggcagcaaccggaaggtgcgggaagcctacctgcagttcatggtgtcagtggccacgttgctgcgggaggatgcaaacctgcccagggacagctgcctggtgcaggaggacatggtgcaggtgctggagctggagacacagctggccaaggccacggtaccccaggaggagagacacgacgtcatcgccttgtaccaccggatgggactggaggagctgcaaagccagtttggcctgaagggatttaactggactctgttcatacaaactgtgctatcctctgtcaaaatcaagctgctgccagatgaggaagtggtggtctatggcatcccctacctgcagaaccttgaaaacatcatcgacacctactcagccaggaccatacagaactacctggtctggcgcctggtgctggaccgcattggtagcctaagccagagattcaaggacacacgagtgaactaccgcaaggcgctgtttggcacaatggtggaggaggtgcgctggcgtgaatgtgtgggctacgtcaacagcaacatggagaacgccgtgggctccctctacgtcagggaggcgttccctggagacagcaagagcatggtcagagaactcattgacaaggtgcggacagtgtttgtggagacgctggacgagctgggctggatggacgaggagtccaagaagaaggcgcaggagaaggccatgagcatccgggagcagatcgggcaccctgactacatcctggaggagatgaacaggcgcctggacgaggagtactccaatctgaacttctcagaggacctgtactttgagaacagtctgcagaacctcaaggtgggcgcccagcggagcctcaggaagcttcgggaaaaggtggacccaaatctctggatcatcggggcggcggtggtcaatgcgttctactccccaaaccgaaaccagattgtattccctgccgggatcctccagccccccttcttcagcaaggagcagccacaggccttgaactttggaggcattgggatggtgatcgggcacgagatcacgcacggctttgacgacaatggccggaacttcgacaagaatggcaacatgatggattggtggagtaacttctccacccagcacttccgggagcagtcagagtgcatgatctaccagtacggcaactactcctgggacctggcagacgaacagaacgtgaacggattcaacacccttggggaaaacattgctgacaacggaggggtgcggcaagcctataaggcctacctcaagtggatggcagagggtggcaaggaccagcagctgcccggcctggatctcacccatgagcagctcttcttcatcaactatgcccaggtgtggtgcgggtcctaccggcccgagttcgccatccaatccatcaagacagacgtccacagtcccctgaagtacagggtactggggtcgctgcagaacctggccgccttcgcagacacgttccactgtgcccggggcacccccatgcaccccaaggagcgatgccgcgtgtggtag

SEQ ID NO: 60 - protein, 225 aa, Artificial Sequence
  Consensus sequence
NAYYNPEFNSLTFPAGYLPILVPPFFDLTYPRAVNSKYGGIGFVLGHEIGHGFDDQGIQLDEEGSLADCWNLRDWKWTDEDNKCFQDRVKCLIDQYSEAVKPDDKGWFNHCANKGATTLGENIADLGGLRAALKAYKKKSSDEEREEQRLPGLENFTPDQLFFETYAYSWCRKSRPENSLRPLLVDPHSPNELRVNGAVRNMPAFASAFNCKPGDKMFPEPEKRC

SEQ ID NO: 61 - protein, 8 aa, Artificial Sequence
  Consensus sequence
  VARIANT (2)...(3): Xaa = any amino acid
  VARIANT (6)...(7): Xaa = any amino acid
  VARIANT (1)...(8): Xaa = Any Amino Acid
VXXHEXXH

SEQ ID NO: 62 - protein, 5 aa, Artificial Sequence
  Zinc-binding active site of metallopeptidases
  VARIANT (3)...(4): Xaa = any amino acid
  VARIANT (1)...(5): Xaa = Any Amino Acid
HEXXH

SEQ ID NO: 63 - DNA, 7334 bp, Homo Sapiens
  CDS (258)...(5912)
ccacgcgtccgggcggaggcgggcgcgggcgcgtccctgtggccagtcacccggaggagttggtcgcacaattatgaaagactcggcttctgctgctagcgccggagctgagttagttctgagaaggtttccctgggcgttccttgtccggcggcctctgctgccgcctccggagacgcttcccgatagatggctacaggccgcggaggaggaggaggtggagttgctgcccttccggagtccgccccgtgaggagaatgtcccagaaatcctggatagaaagcactttgaccaagagggaatgtgtatatattataccaagttccaaggaccctcacagatgccttccaggatgtcaaatttgtcagcaactcgtcaggtgtttttgtggtcgcttggtcaagcaacatgcttgttttactgcaagtcttgccatgaaatactcagatgtgaaattgggtgaccattttaatcaggcaatagaagaatggtctgtggaaaagcatacagaacagagcccaacggatgcttatggagtcataaattttcaagggggttctcattcctacagagctaagtatgtgaggctatcatatgacaccaaacctgaagtcattctgcaacttctgcttaaagaatggcaaatggagttacccaaacttgttatctctgtacatgggggcatgcagaaatttgagcttcacccacgaatcaagcagttgcttggaaaaggtcttattaaagctgcagttacaactggagcctggattttaactggaggagtaaacacaggtgtggcaaaacatgttggagatgccctcaaagaacatgcttccagatcatctcgaaagatttgcactatcggaatagctccatggggagtgattgaaaacagaaatgatcttgttgggagagatgtggttgctccttatcaaaccttattgaaccccctgagcaaattgaatgttttgaataatctgcattcccatttcatattggtggatgatggcactgttggaaagtatggggcggaagtcagactgagaagagaacttgaaaaaactattaatcagcaaagaattcatgctaggattggccagggtgtccctgtggtggcacttatatttgagggtgggccaaatgttatcctcacagttcttgaataccttcaggaaagcccccctgttccagtagttgtgtgtgaaggaacaggcagagctgcagatctgctagcgtatattcataaacaaacagaagaaggagggaatcttcctgatgcagcagggcacgatattatttccactatcaaaaaaacatttaactttggccagaatgaagcacttcatttatttcaaacactgatggagtgcatgaaaagaaaggagcttatcactgttttccatattgggtcagatgaacatcaagatatagatgtagcaatacttactgcactgctaaaaggtactaatgcatctgcatttgaccagcttatccttacattggcatggggtagagttgacattgccaaaaatcatgtatttgtttatggacagcagtggctggttggatccttggaacaagctatgcttgatgctcttgtaatggatagagttgcatttgtaaaacttcttattgaaaatggagtaagcatgcataaattccttaccattccgagactggaagaactttacaacactaaacaaggtccaactaatccaatgctgtttcatcttgttcgagacgtcaaacagggaaatcttcctccaggatataagatcgctctgattgatataggacttgttattgaatatctcatgggaggaacctacagatgcacctatactaggaaacgttttcgattaatatataatagtcttggtggaaataatcggaggtctggccgaaatacctccagcagcactcctcagttgcgaaagagtcatgaattttttggcaatagggcagataaaaaggaaaaaatgaggcataaccatttcattaagacagcacagccctaccgaccaaagattgatacagttatggaagaaggaaagaagaaaagaaccaaagatgaaattgtagacattgatgatccagaaaccaagcgctttccttatccacttaatgaacttttaatttgggcttgccttatgaagaggcaggtcatggcccgttttttatggcaacatggtgaagaatcaatggctaaagcattagttgcctgtaagatctatcgttcaatggcatatgaagcaaagcagagtgacctggtagatgatacttcagaagaactaaaacagtattccaatgattttggtcagttggccgttgaattattagaacagtccttcagacaagatgaaaccatggctatgaaattgctcacttatgaactgaagaactggagtaattcaacctgccttaagttagcagtttcttcaagacttagaccttttgtagctcacacctgtacacaaatgttgttatctgatatgtggatgggaaggctgaatatgaggaaaaattcctggtacaaggtcatactaagcattttagttccacctgccatattgctgttagagtataaaactaaggctgaaatgtcccatatcccacaatctcaagatgctcatcagatgacaatggatgacagcgaaaacaactttcagaacataacagaagagatccccatggaagtgtttaaagaagtacggattttggatagtaatgaaggaaagaatgagatggagatacaaatgaaatcaaaaaagcttccaattacgcgaaagttttatgccttttatcatgcaccaattgtaaaattctggtttaacacgttggcatatttaggatttctgatgctttatacatttgtggttcttgtacaaatggaacagttaccttcagttcaagaatggattgttattgcttatatttttacttatgccattgagaaagtccgtgagatctttatgtctgaagctgggaaagtaaaccagaagattaaagtatggtttagtgattacttcaacatcagtgatacaattgccataatttctttcttcattggatttggactaagatttggagcaaaatggaactttgcaaatgcatatgataatcatgtttttgtggctggaagattaatttactgtcttaacataatattttggtatgtgcgtttgctagattttctagctgtaaatcaacaggcaggaccttatgtaatgatgattggaaaaatggtggccaatatgttctacattgtagtgattatggctcttgtattacttagttttggtgttcccagaaaggcaatactttatcctcatgaagcaccatcttggactcttgctaaagatatagtttttcacccatactggatgatttttggtgaagtttatgcatacgaaattgatgtgtgtgcaaatgattctgttatccctcaaatctgtggtcctgggacgtggttgactccatttcttcaagcagtctacctctttgtacagtatatcattatggttaatcttcttattgcatttttcaacaatgtgtatttacaagtgaaggcaatttccaatattgtatggaagtaccagcgttatcattttattatggcttatcatgagaaaccagttctgcctcctccacttatcattcttagccatatagtttctctgttttgctgcatatgtaagagaagaaagaaagataagacttccgatggaccaaaacttttcttaacagaagaagatcaaaagaaacttcatgattttgaagagcagtgtgttgaaatgtatttcaatgaaaaagatgacaaatttcattctgggagtgaagagagaattcgtgtcacttttgaaagagtggaacagatgtgcattcagattaaagaagttggagatcgtgtcaactacataaaaagatcattacaatcattagattctcaaattggccatttgcaagatctttcagccctgacggtagatacattaaaaacactcactgcccagaaagcgtcggaagctagcaaagttcataatgaaatcacacgagaactgagcatttccaaacacttggctcaaaaccttattgatgatggtcctgtaagaccttctgtatggaaaaagcatggtgttgtaaatacacttagctcctctcttcctcaaggtgatcttgaaagtaataatccttttcattgtaatattttaatgaaagatgacaaagatccccagtgtaatatatttggtcaagacttacctgcagtaccccagagaaaagaatttaattttccagaggctggttcctcttctggtgccttattcccaagtgctgtttcccctccagaactgcgacagagactacatggggtagaactcttaaaaatatttaataaaaatcaaaaattaggcagttcatctactagcataccacatctgtcatccccaccaaccaaattttttgttagtacaccatctcagccaagttgcaaaagccacttggaaactggaaccaaagatcaagaaactgtttgctctaaagctacagaaggagataatacagaatttggagcatttgtaggacacagagatagcatggatttacagaggtttaaagaaacatcaaacaagataaaaatactatccgagcagcagaatgatgtaagaaatgtgattatggagtatacagagatgcctaaatatgagaataacaatacttctgaaaacactttgaaacgagtgagttctcttgctggatttactgactgtcacagaacttccattcctgttcattcaaaacaagcagaaaaaatcagtagaaggccatctaccgaagacactcatgaagtagattccaaagcagctttaataccggattggttacaagatagaccatcaaacagagaaatgccatctgaagaaggaacattaaatggtctcacttctccatttaagccagctatggatacaaattactattattcagctgtggaaagaaataacttgatgaggttatcacagagcattccatttacacctgtgcctccaagaggggagcctgtcacagtgtatcgtttggaagagagttcacccaacatactaaataacagcatgtcttcttggtcacaactaggcctctgtgccaaaatagagtttttaagcaaagaggagatgggaggaggtttacgaagagctgtcaaagtacagtgtacctggtcagaacatgatatcctcaaatcagggcatctttatattatcaaatcttttcttccagaggtggttaatacatggtcaagtatttataaagaagatacagttctgcatctctgtctgagagaaattcaacaacagagagcagcacaaaagcttacgtttgcctttaatcaaatgaaacccaaatccataccatattctccaaggttccttgaagttttcctgctgtattgccattcagcaggacagtggtttgctgtggaagaatgtatgactggagaatttagaaaatacaacaataataatggagatgagattattccaactaatactctggaagagatcatgctagcctttagccactggacttacgaatatacaagaggggagttactggtacttgatttgcaaggtgttggtgaaaatttgactgacccatctgtgataaaagcagaagaaaagagatcctgtgatatggtttttggcccagcaaatctaggagaagatgcaattaaaaacttcagagcaaaacatcactgtaattcttgctgtagaaagcttaaacttccagatctgaagaggaatgattatacgcctgataaaattatatttcctcaggatgagccttcagatttgaatcttcagcctggaaattccaccaaagaatcagaatcaactaattctgttcgtctgatgttataatattaatattactgaatcattggttttgcctgcacctcacagaaatgttactgtgtcacttttccctcgggaggaaattgtttggtaatatagaaaggtgtatgcaagttgaatttgctgactccagcacagttaaaaggtcaatattcttttgacctgattaatcagtcagaaagtccctataggatagagctggcagctgagaaattttaaaggtaattgataattagtatttgtaactttttaaagggctctttgtatagcagaggatctcatttgactttgttttgatgagggtgatgccctctcttatgtggtacaataccattaaccaaaggtaggtgtccatgcagattttattggcagctgttttattgccattcaactagggaaatgaagaaatcacgcagccttttggttaaatggcagtcaaaattttcctcagtgtatttagtgtgttcagtgatgatatcactggttcccaactagatgcttgttggccacgggaagggaaatgacttgttctaattctaggttcacagaggtatgagaagcctgaactgaagaccattttcaagagggacggtatttatgaatcagggttaggctccatatttaaagatagagccagtttttttttttaaatagaacccaaattgtgtaaaaatgttaattgggttttttaaacattgttttatcaagtcactgttaagtagaagaaagccatggtaaactgatacataacctaaattataaaagcagaaacctaactcactcgtcaagggaagttaccttttgaggaaagttaaagtacttttttccctatctgtatctatagcaacaacccagaacttacaaacttctccaaagattttattgattgttatatcaaatcagaatgtaaacatgaactcttgcatatatttaaaattgtgttggaacatttgaacatgaatgctgtttgtggtacttaagaaattaattcagttggattatcattatgtgatactggcagattgcagtgcaaccttatgccaataaaatgtaatttaacagccccagatattgttgaatattcaacaataacaagaaaagcttttcatctaagttttatgctttaattttttttctttttttttctttttcttttgtttccttggtactaattttaatttttatttggaagggagcagtataaagcttatttgtatttagtagtgtatctcatagatacagacaaggcaagagatgataagctgtttaaatagtgtttaatattgattgggggtggggagaaagaaaaagtgtattacttaaagatactatatacgttttgtatatcattaaatctttaaaagaaatgaaataaatttattgtttacagatgaaaaaaaaaaaaaaaaaaaaaagggcggccgc

SEQ ID NO: 64 - protein, 1885 aa, Homo Sapiens
MSQKSWIESTLTKRECVYIIPSSKDPHRCLPGCQICQQLVRCFCGRLVKQHACFTASLAMKYSDVKLGDHFNQAIEEWSVEKHTEQSPTDAYGVINFQGGSHSYRAKYVRLSYDTKPEVILQLLLKEWQMELPKLVISVHGGMQKFELHPRIKQLLGKGLIKAAVTTGAWILTGGVNTGVAKHVGDALKEHASRSSRKICTIGIAPWGVIENRNDLVGRDVVAPYQTLLNPLSKLNVLNNLHSHFILVDDGTVGKYGAEVRLRRELEKTINQQRIHARIGQGVPVVALIFEGGPNVILTVLEYLQESPPVPVVVCEGTGRAADLLAYIHKQTEEGGNLPDAAGHDIISTIKKTFNFGQNEALHLFQTLMECMKRKELITVFHIGSDEHQDIDVAILTALLKGTNASAFDQLILTLAWGRVDIAKNHVFVYGQQWLVGSLEQAMLDALVMDRVAFVKLLIENGVSMHKFLTIPRLEELYNTKQGPTNPMLFHLVRDVKQGNLPPGYKIALIDIGLVIEYLMGGTYRCTYTRKRFRLIYNSLGGNNRRSGRNTSSSTPQLRKSHEFFGNRADKKEKMRHNHFIKTAQPYRPKIDTVMEEGKKKRTKDEIVDIDDPETKRFPYPLNELLIWACLMKRQVMARFLWQHGEESMAKALVACKIYRSMAYEAKQSDLVDDTSEELKQYSNDFGQLAVELLEQSFRQDETMAMKLLTYELKNWSNSTCLKLAVSSRLRPFVAHTCTQMLLSDMWMGRLNMRKNSWYKVILSILVPPAILLLEYKTKAEMSHIPQSQDAHQMTMDDSENNFQNITEEIPMEVFKEVRILDSNEGKNEMEIQMKSKKLPITRKFYAFYHAPIVKFWFNTLAYLGFLMLYTFVVLVQMEQLPSVQEWIVIAYIFTYAIEKVREIFMSEAGKVNQKIKVWFSDYFNISDTIAIISFFIGFGLRFGAKWNFANAYDNHVFVAGRLIYCLNIIFWYVRLLDFLAVNQQAGPYVMMIGKMVANMFYIVVIMALVLLSFGVPRKAILYPHEAPSWTLAKDIVFHPYWMIFGEVYAYEIDVCANDSVIPQICGPGTWLTPFLQAVYLFVQYIIMVNLLIAFFNNVYLQVKAISNIVWKYQRYHFIMAYHEKPVLPPPLIILSHIVSLFCCICKRRKKDKTSDGPKLFLTEEDQKKLHDFEEQCVEMYFNEKDDKFHSGSEERIRVTFERVEQMCIQIKEVGDRVNYIKRSLQSLDSQIGHLQDLSALTVDTLKTLTAQKASEASKVHNEITRELSISKHLAQNLIDDGPVRPSVWKKHGVVNTLSSSLPQGDLESNNPFHCNILMKDDKDPQCNIFGQDLPAVPQRKEFNFPEAGSSSGALFPSAVSPPELRQRLHGVELLKIFNKNQKLGSSSTSIPHLSSPPTKFFVSTPSQPSCKSHLETGTKDQETVCSKATEGDNTEFGAFVGHRDSMDLQRFKETSNKIKILSEQQNDVRNVIMEYTEMPKYENNNTSENTLKRVSSLAGFTDCHRTSIPVHSKQAEKISRRPSTEDTHEVDSKAALIPDWLQDRPSNREMPSEEGTLNGLTSPFKPAMDTNYYYSAVERNNLMRLSQSIPFTPVPPRGEPVTVYRLEESSPNILNNSMSSWSQLGLCAKIEFLSKEEMGGGLRRAVKVQCTWSEHDILKSGHLYIIKSFLPEVVNTWSSIYKEDTVLHLCLREIQQQRAAQKLTFAFNQMKPKSIPYSPRFLEVFLLYCHSAGQWFAVEECMTGEFRKYNNNNGDEIIPTNTLEEIMLAFSHWTYEYTRGELLVLDLQGVGENLTDPSVIKAEEKRSCDMVFGPANLGEDAIKNFRAKHHCNSCCRKLKLPDLKRNDYTPDKIIFPQDEPSDLNLQPGNSTKESESTNSVRLML

SEQ ID NO: 65 - DNA, 5658 bp, Homo Sapiens
  CDS (1)...(5658)
atgtcccagaaatcctggatagaaagcactttgaccaagagggaatgtgtatatattataccaagttccaaggaccctcacagatgccttccaggatgtcaaatttgtcagcaactcgtcaggtgtttttgtggtcgcttggtcaagcaacatgcttgttttactgcaagtcttgccatgaaatactcagatgtgaaattgggtgaccattttaatcaggcaatagaagaatggtctgtggaaaagcatacagaacagagcccaacggatgcttatggagtcataaattttcaagggggttctcattcctacagagctaagtatgtgaggctatcatatgacaccaaacctgaagtcattctgcaacttctgcttaaagaatggcaaatggagttacccaaacttgttatctctgtacatgggggcatgcagaaatttgagcttcacccacgaatcaagcagttgcttggaaaaggtcttattaaagctgcagttacaactggagcctggattttaactggaggagtaaacacaggtgtggcaaaacatgttggagatgccctcaaagaacatgcttccagatcatctcgaaagatttgcactatcggaatagctccatggggagtgattgaaaacagaaatgatcttgttgggagagatgtggttgctccttatcaaaccttattgaaccccctgagcaaattgaatgttttgaataatctgcattcccatttcatattggtggatgatggcactgttggaaagtatggggcggaagtcagactgagaagagaacttgaaaaaactattaatcagcaaagaattcatgctaggattggccagggtgtccctgtggtggcacttatatttgagggtgggccaaatgttatcctcacagttcttgaataccttcaggaaagcccccctgttccagtagttgtgtgtgaaggaacaggcagagctgcagatctgctagcgtatattcataaacaaacagaagaaggagggaatcttcctgatgcagcagggcacgatattatttccactatcaaaaaaacatttaactttggccagaatgaagcacttcatttatttcaaacactgatggagtgcatgaaaagaaaggagcttatcactgttttccatattgggtcagatgaacatcaagatatagatgtagcaatacttactgcactgctaaaaggtactaatgcatctgcatttgaccagcttatccttacattggcatggggtagagttgacattgccaaaaatcatgtatttgtttatggacagcagtggctggttggatccttggaacaagctatgcttgatgctcttgtaatggatagagttgcatttgtaaaacttcttattgaaaatggagtaagcatgcataaattccttaccattccgagactggaagaactttacaacactaaacaaggtccaactaatccaatgctgtttcatcttgttcgagacgtcaaacagggaaatcttcctccaggatataagatcgctctgattgatataggacttgttattgaatatctcatgggaggaacctacagatgcacctatactaggaaacgttttcgattaatatataatagtcttggtggaaataatcggaggtctggccgaaatacctccagcagcactcctcagttgcgaaagagtcatgaattttttggcaatagggcagataaaaaggaaaaaatgaggcataaccatttcattaagacagcacagccctaccgaccaaagattgatacagttatggaagaaggaaagaagaaaagaaccaaagatgaaattgtagacattgatgatccagaaaccaagcgctttccttatccacttaatgaacttttaatttgggcttgccttatgaagaggcaggtcatggcccgttttttatggcaacatggtgaagaatcaatggctaaagcattagttgcctgtaagatctatcgttcaatggcatatgaagcaaagcagagtgacctggtagatgatacttcagaagaactaaaacagtattccaatgattttggtcagttggccgttgaattattagaacagtccttcagacaagatgaaaccatggctatgaaattgctcacttatgaactgaagaactggagtaattcaacctgccttaagttagcagtttcttcaagacttagaccttttgtagctcacacctgtacacaaatgttgttatctgatatgtggatgggaaggctgaatatgaggaaaaattcctggtacaaggtcatactaagcattttagttccacctgccatattgctgttagagtataaaactaaggctgaaatgtcccatatcccacaatctcaagatgctcatcagatgacaatggatgacagcgaaaacaactttcagaacataacagaagagatccccatggaagtgtttaaagaagtacggattttggatagtaatgaaggaaagaatgagatggagatacaaatgaaatcaaaaaagcttccaattacgcgaaagttttatgccttttatcatgcaccaattgtaaaattctggtttaacacgttggcatatttaggatttctgatgctttatacatttgtggttcttgtacaaatggaacagttaccttcagttcaagaatggattgttattgcttatatttttacttatgccattgagaaagtccgtgagatctttatgtctgaagctgggaaagtaaaccagaagattaaagtatggtttagtgattacttcaacatcagtgatacaattgccataatttctttcttcattggatttggactaagatttggagcaaaatggaactttgcaaatgcatatgataatcatgtttttgtggctggaagattaatttactgtcttaacataatattttggtatgtgcgtttgctagattttctagctgtaaatcaacaggcaggaccttatgtaatgatgattggaaaaatggtggccaatatgttctacattgtagtgattatggctcttgtattacttagttttggtgttcccagaaaggcaatactttatcctcatgaagcaccatcttggactcttgctaaagatatagtttttcacccatactggatgatttttggtgaagtttatgcatacgaaattgatgtgtgtgcaaatgattctgttatccctcaaatctgtggtcctgggacgtggttgactccatttcttcaagcagtctacctctttgtacagtatatcattatggttaatcttcttattgcatttttcaacaatgtgtatttacaagtgaaggcaatttccaatattgtatggaagtaccagcgttatcattttattatggcttatcatgagaaaccagttctgcctcctccacttatcattcttagccatatagtttctctgttttgctgcatatgtaagagaagaaagaaagataagacttccgatggaccaaaacttttcttaacagaagaagatcaaaagaaacttcatgattttgaagagcagtgtgttgaaatgtatttcaatgaaaaagatgacaaatttcattctgggagtgaagagagaattcgtgtcacttttgaaagagtggaacagatgtgcattcagattaaagaagttggagatcgtgtcaactacataaaaagatcattacaatcattagattctcaaattggccatttgcaagatctttcagccctgacggtagatacattaaaaacactcactgcccagaaagcgtcggaagctagcaaagttcataatgaaatcacacgagaactgagcatttccaaacacttggctcaaaaccttattgatgatggtcctgtaagaccttctgtatggaaaaagcatggtgttgtaaatacacttagctcctctcttcctcaaggtgatcttgaaagtaataatccttttcattgtaatattttaatgaaagatgacaaagatccccagtgtaatatatttggtcaagacttacctgcagtaccccagagaaaagaatttaattttccagaggctggttcctcttctggtgccttattcccaagtgctgtttcccctccagaactgcgacagagactacatggggtagaactcttaaaaatatttaataaaaatcaaaaattaggcagttcatctactagcataccacatctgtcatccccaccaaccaaattttttgttagtacaccatctcagccaagttgcaaaagccacttggaaactggaaccaaagatcaagaaactgtttgctctaaagctacagaaggagataatacagaatttggagcatttgtaggacacagagatagcatggatttacagaggtttaaagaaacatcaaacaagataaaaatactatccgagcagcagaatgatgtaagaaatgtgattatggagtatacagagatgcctaaatatgagaataacaatacttctgaaaacactttgaaacgagtgagttctcttgctggatttactgactgtcacagaacttccattcctgttcattcaaaacaagcagaaaaaatcagtagaaggccatctaccgaagacactcatgaagtagattccaaagcagctttaataccggattggttacaagatagaccatcaaacagagaaatgccatctgaagaaggaacattaaatggtctcacttctccatttaagccagctatggatacaaattactattattcagctgtggaaagaaataacttgatgaggttatcacagagcattccatttacacctgtgcctccaagaggggagcctgtcacagtgtatcgtttggaagagagttcacccaacatactaaataacagcatgtcttcttggtcacaactaggcctctgtgccaaaatagagtttttaagcaaagaggagatgggaggaggtttacgaagagctgtcaaagtacagtgtacctggtcagaacatgatatcctcaaatcagggcatctttatattatcaaatcttttcttccagaggtggttaatacatggtcaagtatttataaagaagatacagttctgcatctctgtctgagagaaattcaacaacagagagcagcacaaaagcttacgtttgcctttaatcaaatgaaacccaaatccataccatattctccaaggttccttgaagttttcctgctgtattgccattcagcaggacagtggtttgctgtggaagaatgtatgactggagaatttagaaaatacaacaataataatggagatgagattattccaactaatactctggaagagatcatgctagcctttagccactggacttacgaatatacaagaggggagttactggtacttgatttgcaaggtgttggtgaaaatttgactgacccatctgtgataaaagcagaagaaaagagatcctgtgatatggtttttggcccagcaaatctaggagaagatgcaattaaaaacttcagagcaaaacatcactgtaattcttgctgtagaaagcttaaacttccagatctgaagaggaatgattatacgcctgataaaattatatttcctcaggatgagccttcagatttgaatcttcagcctggaaattccaccaaagaatcagaatcaactaattctgttcgtctgatgttataa

SEQ ID NO: 66 - DNA, 2846 bp, Homo Sapiens
  CDS (245)...(2299)
  misc_feature (1)...(2846): n = A,T,C or G
agtttagtctttttgtcttttaattncaaggtnccggatccggtggtggtgcaaaatcaaagaaactgctcntcagtggatgttgcctttacttctaggcctgtacggaagtgttacttctgctctaaaagctgcggaattctaatacgactcactatagggagtcgacccacgcgtccgggccccaggaagttgcaagagtaccatttgtcgcacactcggggaccgcgggtggccggaggagatgaaaccgtcttggctgcagtgtcgtaaagtcaccagcgccggggggctcggagggcccttgcctgggtcctctccggcccggggagccggtgcggccctcagggctttagtggtcccgggcccgcggggcggtctcgggggccggggatgcagggcactgtcctccggcagtggcagcgagtacaagacccacttcgcagcctcggtgaccgaccccgagaggttctggggcaaagctgccgagcagatcagctggtacaagccctggaccaaaacgctggagaacaaacactcgccctctaccaggtttgtggaaggaatgcttaacatttgttacaatgccgttgatcgtcatattgaaaatggtaaaggggataagattgctatcatctatgacagtcctgttacaaacactaaagcaacctttacctataaagaagttctggagcaggtctccaagctggctggtgtcttggtcaagcatggcatcaagaaaggtgacactgtggttatctacatgcctatgatcccacaggcgatgtataccatgttggcatgtgcaaggataggtgccatccacagtctcatatttggaggatttgcttccaaagaactaagtagtcgcattgatcatgtaaagcccaaggtggttgttacagcatcatttggcattgaacctggaaggagggtagagtacgtaccacttgtagaagaagcgctaaaaataggacaacacaaaccagacaaaattctcatttataatcgtccaaatatggaggcggttcctttggctcccggtcgtgaccttgattgggatgaagagatggcaaaagcccagtcacatgactgtgttcctgttctttcagaacacccactgtatattctttacacatctggcacaacggggttacctaagggtgtgattaggcccactgggggatacgctgtcatgctacactggtcaatgtcttccatatacggacttcaacccggagaggtgtggtgggcagcttctgacttaggctgggttgttggacattcctatatctgctatggacctcttcttcatgggaacacaacagttttatatgaggggaagcctgtgggaacaccagatgctggcgcttatttccgtgtgcttgcagagcatggagtagctgccttgtttacagcaccaactgcaattagagcaatccgtcaacaggaccctggggcagctttggggaagcagtactctctgacaaggttcaaaacattatttgtggctggagaacgatgtgatgtagagaccctggaatggtccaaaaatgtcttcagagtacctgtcttagaccattggtggcaaactgagactggatctccaattactgcgtcatgtgttggattaggcaattctaaaacacctccaccagggcaagcaggaaaaagcgtcccaggatacaatgttatgattttggatgacaacatgcaaaaactgaaggctcggtgtttaggaaatattgtggtaaagttaccattgccacctggggctttttcaggactctggaagaatcaggaagcattcaagcatttatactttgaaaaatttcctggatattatgataccatggatgctggttacatggatgaagaaggctatttgtatgttatgtctcgagtggatgatgtaataaatgttgcaggtcacagaatttctgcaggcgccattgaagagtcaatcctttcccatggtaccgtggcagactgtgctgttgttggcaaggaagatcccttaaaaggtcatgtccccttagcactctgtgtattgagaaaagatataaatgcaacagaggagcaagttttggaagaaattgtgaaacacgttagacagaacattggccctgtggctgcttttcgaaatgcagtgtttgtcaaacagctacccaaaaccagatctggcaagatcccccgatcagctttatctgccattgtcaatggcaagccatacaagataacttctacaattgaagaccccagcatttttggccacgtagaagaaatgctgaagcaagcataatgagtttgtcttattcctattttgagttgatttaatttcttaattgaaattaaattatttgagttgtttctcagaaataaatatttcagtagaaattacttgcaaaatgaaatgtgaattgtaaaacttggcctaaacaaatctaatgaaaacatgtgaaagacctgtgccttttttttggtttgaccctgttagcattgttattagttatctataacatggcttattgaatgtcatctactgctttaggaaaaacgtatctagtgtattatttttaaaattgtacctcccaagaagaacactttaattgaaagcmacactaatatagagccacttyctgraaccaagrawyykkwrkkttkwkmymmaawmtmwaamwwmmwktmarrwmakaawwwaawtwwwwmttktwswwrtwkwaratwttwkmwartwttctwwaratkctywmrwtgytttaaataaaatagatgaaatgggaagtttaggtaatcatctagacagatgaaattattatctaggtaggagggcttttctatacatt

SEQ ID NO: 67 - protein, 685 aa, Homo Sapiens
MKPSWLQCRKVTSAGGLGGPLPGSSPARGAGAALRALVVPGPRGGLGGRGCRALSSGSGSEYKTHFAASVTDPERFWGKAAEQISWYKPWTKTLENKHSPSTRFVEGMLNICYNAVDRHIENGKGDKIAIIYDSPVTNTKATFTYKEVLEQVSKLAGVLVKHGIKKGDTVVIYMPMIPQAMYTMLACARIGAIHSLIFGGFASKELSSRIDHVKPKVVVTASFGIEPGRRVEYVPLVEEALKIGQHKPDKILIYNRPNMEAVPLAPGRDLDWDEEMAKAQSHDCVPVLSEHPLYILYTSGTTGLPKGVIRPTGGYAVMLHWSMSSIYGLQPGEVWWAASDLGWVVGHSYICYGPLLHGNTTVLYEGKPVGTPDAGAYFRVLAEHGVAALFTAPTAIRAIRQQDPGAALGKQYSLTRFKTLFVAGERCDVETLEWSKNVFRVPVLDHWWQTETGSPITASCVGLGNSKTPPPGQAGKSVPGYNVMILDDNMQKLKARCLGNIVVKLPLPPGAFSGLWKNQEAFKHLYFEKFPGYYDTMDAGYMDEEGYLYVMSRVDDVINVAGHRISAGAIEESILSHGTVADCAVVGKEDPLKGHVPLALCVLRKDINATEEQVLEEIVKHVRQNIGPVAAFRNAVFVKQLPKTRSGKIPRSALSAIVNGKPYKITSTIEDPSIFGHVEEMLKQA

SEQ ID NO: 68 - DNA, 2058 bp, Homo Sapiens
  CDS (1)...(2058)
atgaaaccgtcttggctgcagtgtcgtaaagtcaccagcgccggggggctcggagggcccttgcctgggtcctctccggcccggggagccggtgcggccctcagggctttagtggtcccgggcccgcggggcggtctcgggggccggggatgcagggcactgtcctccggcagtggcagcgagtacaagacccacttcgcagcctcggtgaccgaccccgagaggttctggggcaaagctgccgagcagatcagctggtacaagccctggaccaaaacgctggagaacaaacactcgccctctaccaggtttgtggaaggaatgcttaacatttgttacaatgccgttgatcgtcatattgaaaatggtaaaggggataagattgctatcatctatgacagtcctgttacaaacactaaagcaacctttacctataaagaagttctggagcaggtctccaagctggctggtgtcttggtcaagcatggcatcaagaaaggtgacactgtggttatctacatgcctatgatcccacaggcgatgtataccatgttggcatgtgcaaggataggtgccatccacagtctcatatttggaggatttgcttccaaagaactaagtagtcgcattgatcatgtaaagcccaaggtggttgttacagcatcatttggcattgaacctggaaggagggtagagtacgtaccacttgtagaagaagcgctaaaaataggacaacacaaaccagacaaaattctcatttataatcgtccaaatatggaggcggttcctttggctcccggtcgtgaccttgattgggatgaagagatggcaaaagcccagtcacatgactgtgttcctgttctttcagaacacccactgtatattctttacacatctggcacaacggggttacctaagggtgtgattaggcccactgggggatacgctgtcatgctacactggtcaatgtcttccatatacggacttcaacccggagaggtgtggtgggcagcttctgacttaggctgggttgttggacattcctatatctgctatggacctcttcttcatgggaacacaacagttttatatgaggggaagcctgtgggaacaccagatgctggcgcttatttccgtgtgcttgcagagcatggagtagctgccttgtttacagcaccaactgcaattagagcaatccgtcaacaggaccctggggcagctttggggaagcagtactctctgacaaggttcaaaacattatttgtggctggagaacgatgtgatgtagagaccctggaatggtccaaaaatgtcttcagagtacctgtcttagaccattggtggcaaactgagactggatctccaattactgcgtcatgtgttggattaggcaattctaaaacacctccaccagggcaagcaggaaaaagcgtcccaggatacaatgttatgattttggatgacaacatgcaaaaactgaaggctcggtgtttaggaaatattgtggtaaagttaccattgccacctggggctttttcaggactctggaagaatcaggaagcattcaagcatttatactttgaaaaatttcctggatattatgataccatggatgctggttacatggatgaagaaggctatttgtatgttatgtctcgagtggatgatgtaataaatgttgcaggtcacagaatttctgcaggcgccattgaagagtcaatcctttcccatggtaccgtggcagactgtgctgttgttggcaaggaagatcccttaaaaggtcatgtccccttagcactctgtgtattgagaaaagatataaatgcaacagaggagcaagttttggaagaaattgtgaaacacgttagacagaacattggccctgtggctgcttttcgaaatgcagtgtttgtcaaacagctacccaaaaccagatctggcaagatcccccgatcagctttatctgccattgtcaatggcaagccatacaagataacttctacaattgaagaccccagcatttttggccacgtagaagaaatgctgaagcaagcataa

SEQ ID NO: 69 - protein, 458 aa, Artificial Sequence
  Consensus sequence
TYRELNERANRLARHLRSEKGVKPGDLVAILMERSPEMIVAILGILKTYRELNERANRLARHLRSEKGVKPGDLVAILMERSPEMIVAILGILKLLKLAPDESANGPNVGVVHVLLLDEELADVVELDELAPHELVPEQSEENLQPPVKPEDLAYIIYTSGTTGKPKGVMVEHRNVVNLLQWLKERYGLTEEDDDRVLQFASDAYVFDASVWDLFAALLAGATLVIVPKETRYLDPEALYQYIEKEGVTVLSLTPSLLRMLMPARTFANDKQDLPSLRTLIFGGEALSPSLVDKWRERFGNEKGRLINTYGPTETTVVTTVNRITPEEIRQKSVPIGRPLPNTQVYILDENGQLVPIGVAGELYIGGWPGVARGYLNRPELTAERFVPNPFQPGEERRGRNRRMYRTGDLARWLPDGTIEYLGRIDDQVKIRGYRIELGEIEAALRLLQHPGVKEAVV

SEQ ID NO: 70 - protein, 12 aa, Artificial Sequence
  Consensus sequence
  VARIANT (1)...(1): Xaa = L, I, V, M, F or Y
  VARIANT (2)...(3): Xaa = Any amino acid
  VARIANT (4)...(4): Xaa = S, T or G
  VARIANT (5)...(5): Xaa = S, T, A or G
  VARIANT (7)...(7): Xaa = S or T
  VARIANT (8)...(8): Xaa = S, T, E or I
  VARIANT (9)...(9): Xaa = S or G
  VARIANT (10)...(10): Xaa = Any amino acid
  VARIANT (11)...(11): Xaa = P, A, S, L, I, V or M
  VARIANT (12)...(12): Xaa = K or R
XXXXXGXXXXXX

SEQ ID NO: 71 - DNA, 2920 bp, Homo Sapiens
  CDS (143)...(2401)
cgtccgccacgcgtccggactagttctagatcgcgagcggccgcccttttttttttttttttggaagtcctaggactgatctccaggaccagcactcttctcccagcccttagggtcctgctcggccaaggccttccctgccatgcgacctgtcagtgtctggcagtggagcccctgggggctgctgctgtgcctgctgtgcagttcgtgcttggggtctccgtccccttccacgggccctgagaagaaggccgggagccaggggcttcggttccggctggctggcttccccaggaagccctacgagggccgcgtggagatacagcgagctggtgaatggggcaccatctgcgatgatgacttcacgctgcaggctgcccacatcctctgccgggagctgggcttcacagaggccacaggctggacccacagtgccaaatatggccctggaacaggccgcatctggctggacaacttgagctgcagtgggaccgagcagagtgtgactgaatgtgcctcccggggctgggggaacagtgactgtacgcacgatgaggatgctggggtcatctgcaaagaccagcgcctccctggcttctcggactccaatgtcattgaggtagagcatcacctgcaagtggaggaggtgcgaattcgacccgccgttgggtggggcagacgacccctgcccgtgacggaggggctggtggaagtcaggcttcctgacggctggtcgcaagtgtgcgacaaaggctggagcgcccacaacagccacgtggtctgcgggatgctgggcttccccagcgaaaagagggtcaacgcggccttctacaggctgctagcccaacggcagcaacactcctttggtctgcatggggtggcgtgcgtgggcacggaggcccacctctccctctgttccctggagttctatcgtgccaatgacaccgccaggtgccctggggggggccctgcagtggtgagctgtgtgccaggccctgtctacgcggcatccagtggccagaagaagcaacaacagtcgaagcctcagggggaggcccgtgtccgtctaaagggcggcgcccaccctggagagggccgggtagaagtcctgaaggccagcacatggggcacagtctgtgaccgcaagtgggacctgcatgcagccagcgtggtgtgtcgggagctgggcttcgggagtgctcgagaagctctgagtggcgctcgcatggggcagggcatgggtgctatccacctgagtgaagttcgctgctctggacaggagctctccctctggaagtgcccccacaagaacatcacagctgaggattgttcacatagccaggatgccggggtccggtgcaacctaccttacactggggcagagaccaggatccgactcagtgggggccgcagccaacatgaggggcgagtcgaggtgcaaatagggggacctgggccccttcgctggggcctcatctgtggggatgactgggggaccctggaggccatggtggcctgtaggcaactgggtctgggctacgccaaccacggcctgcaggagacctggtactgggactctgggaatataacagaggtggtgatgagtggagtgcgctgcacagggactgagctgtccctggatcagtgtgcccatcatggcacccacatcacctgcaagaggacagggacccgcttcactgctggagtcatctgttctgagactgcatcagatctgttgctgcactcagcactggtgcaggagaccgcctacatcgaagaccggcccctgcatatgttgtactgtgctgcggaagagaactgcctggccagctcagcccgctcagccaactggccctatggtcaccggcgtctgctccgattctcctcccagatccacaacctgggacgagctgacttcaggcccaaggctgggcgccactcctgggtgtggcacgagtgccatgggcattaccacagcatggacatcttcactcactatgatatcctcaccccaaatggcaccaaggtggctgagggccacaaagctagtttctgtctcgaagacactgagtgtcaggaggatgtctccaagcggtatgagtgtgccaactttggagagcaaggcatcactgtgggttgctgggatctctaccggcatgacattgactgtcagtggattgacatcacggatgtgaagccaggaaactacattctccaggttgtcatcaacccaaactttgaagtagcagagagtgactttaccaacaatgcaatgaaatgtaactgcaaatatgatggacatagaatctgggtgcacaactgccacattggtgatgccttcagtgaagaggccaacaggaggtttgaacgctaccctggccagaccagcaaccagattatctaagtgccactgccctctgcaaaccaccactggcccctaatggcaggggtctgaggctgccattacctcaggagcttaccaagaaacccatgtcagcaaccgcactcatcagaccatgcactatggatgtggaactgtcaagcagaagttttcaccctccttcagaggccagctgtcagtatctgtagccaagcatgggaatctttgctcccaggcccagcaccgagcagaacagaccagagcccaccacaccacaaagagcagcacctgactaactgcccacaaaagatggcagcagctcattttctttaataggaggtcaggatggtcagctccagtatctcccctaagtttagggggatacagctttacctctagccttttggtgggggaaaagatccagccctcccacctcattttttactataatatgttgctaggtataattttattttatataaaaagtgtttctgtgattcttcagaaaaaaaaaaaaaaaaaaaaaaaaaaaaaaaaaaa

SEQ ID NO: 72 - protein, 753 aa, Homo Sapiens
MRPVSVWQWSPWGLLLCLLCSSCLGSPSPSTGPEKKAGSQGLRFRLAGFPRKPYEGRVEIQRAGEWGTICDDDFTLQAAHILCRELGFTEATGWTHSAKYGPGTGRIWLDNLSCSGTEQSVTECASRGWGNSDCTHDEDAGVICKDQRLPGFSDSNVIEVEHHLQVEEVRIRPAVGWGRRPLPVTEGLVEVRLPDGWSQVCDKGWSAHNSHVVCGMLGFPSEKRVNAAFYRLLAQRQQHSFGLHGVACVGTEAHLSLCSLEFYRANDTARCPGGGPAVVSCVPGPVYAASSGQKKQQQSKPQGEARVRLKGGAHPGEGRVEVLKASTWGTVCDRKWDLHAASVVCRELGFGSAREALSGARMGQGMGAIHLSEVRCSGQELSLWKCPHKNITAEDCSHSQDAGVRCNLPYTGAETRIRLSGGRSQHEGRVEVQIGGPGPLRWGLICGDDWGTLEAMVACRQLGLGYANHGLQETWYWDSGNITEVVMSGVRCTGTELSLDQCAHHGTHITCKRTGTRFTAGVICSETASDLLLHSALVQETAYIEDRPLHMLYCAAEENCLASSARSANWPYGHRRLLRFSSQIHNLGRADFRPKAGRHSWVWHECHGHYHSMDIFTHYDILTPNGTKVAEGHKASFCLEDTECQEDVSKRYECANFGEQGITVGCWDLYRHDIDCQWIDITDVKPGNYILQVVINPNFEVAESDFTNNAMKCNCKYDGHRIWVHNCHIGDAFSEEANRRFERYPGQTSNQII

SEQ ID NO: 73 - DNA, 2262 bp, Homo Sapiens
  CDS (1)...(2262)
atgcgacctgtcagtgtctggcagtggagcccctgggggctgctgctgtgcctgctgtgcagttcgtgcttggggtctccgtccccttccacgggccctgagaagaaggccgggagccaggggcttcggttccggctggctggcttccccaggaagccctacgagggccgcgtggagatacagcgagctggtgaatggggcaccatctgcgatgatgacttcacgctgcaggctgcccacatcctctgccgggagctgggcttcacagaggccacaggctggacccacagtgccaaatatggccctggaacaggccgcatctggctggacaacttgagctgcagtgggaccgagcagagtgtgactgaatgtgcctcccggggctgggggaacagtgactgtacgcacgatgaggatgctggggtcatctgcaaagaccagcgcctccctggcttctcggactccaatgtcattgaggtagagcatcacctgcaagtggaggaggtgcgaattcgacccgccgttgggtggggcagacgacccctgcccgtgacggaggggctggtggaagtcaggcttcctgacggctggtcgcaagtgtgcgacaaaggctggagcgcccacaacagccacgtggtctgcgggatgctgggcttccccagcgaaaagagggtcaacgcggccttctacaggctgctagcccaacggcagcaacactcctttggtctgcatggggtggcgtgcgtgggcacggaggcccacctctccctctgttccctggagttctatcgtgccaatgacaccgccaggtgccctggggggggccctgcagtggtgagctgtgtgccaggccctgtctacgcggcatccagtggccagaagaagcaacaacagtcgaagcctcagggggaggcccgtgtccgtctaaagggcggcgcccaccctggagagggccgggtagaagtcctgaaggccagcacatggggcacagtctgtgaccgcaagtgggacctgcatgcagccagcgtggtgtgtcgggagctgggcttcgggagtgctcgagaagctctgagtggcgctcgcatggggcagggcatgggtgctatccacctgagtgaagttcgctgctctggacaggagctctccctctggaagtgcccccacaagaacatcacagctgaggattgttcacatagccaggatgccggggtccggtgcaacctaccttacactggggcagagaccaggatccgactcagtgggggccgcagccaacatgaggggcgagtcgaggtgcaaatagggggacctgggccccttcgctggggcctcatctgtggggatgactgggggaccctggaggccatggtggcctgtaggcaactgggtctgggctacgccaaccacggcctgcaggagacctggtactgggactctgggaatataacagaggtggtgatgagtggagtgcgctgcacagggactgagctgtccctggatcagtgtgcccatcatggcacccacatcacctgcaagaggacagggacccgcttcactgctggagtcatctgttctgagactgcatcagatctgttgctgcactcagcactggtgcaggagaccgcctacatcgaagaccggcccctgcatatgttgtactgtgctgcggaagagaactgcctggccagctcagcccgctcagccaactggccctatggtcaccggcgtctgctccgattctcctcccagatccacaacctgggacgagctgacttcaggcccaaggctgggcgccactcctgggtgtggcacgagtgccatgggcattaccacagcatggacatcttcactcactatgatatcctcaccccaaatggcaccaaggtggctgagggccacaaagctagtttctgtctcgaagacactgagtgtcaggaggatgtctccaagcggtatgagtgtgccaactttggagagcaaggcatcactgtgggttgctgggatctctaccggcatgacattgactgtcagtggattgacatcacggatgtgaagccaggaaactacattctccaggttgtcatcaacccaaactttgaagtagcagagagtgactttaccaacaatgcaatgaaatgtaactgcaaatatgatggacatagaatctgggtgcacaactgccacattggtgatgccttcagtgaagaggccaacaggaggtttgaacgctaccctggccagaccagcaaccagattatctaa

SEQ ID NO: 74 - protein, 38 aa, Artificial Sequence
  SRRD signature consensus sequence
  VARIANT (2)...(6): Xaa = Any amino acid
  VARIANT (8)...(9): Xaa = Any amino acid
  VARIANT (11)...(16): Xaa = Any amino acid
  VARIANT (19)...(20): Xaa = Any amino acid
  VARIANT (22)...(33): Xaa = Any amino acid
  VARIANT (35)...(37): Xaa = Any amino acid
GXXXXXGXXEXXXXXXWGXXCXXXXXXXXXXXXCXXXG

SEQ ID NO: 75 - protein, 417 aa, Homo Sapiens
MRFAWTVLLLGPLQLCALVHCAPPAAGQQQPPREPPAAPGAWRQQIQWENNGQVFSLLSLGSQYQPQRRRDPGAAVPGAANASAQQPRTPILLIRDNRTAAGRTRTAGSSGVTAGRPRPTARHWFQAGYSTSRAREAGPSRAENQTAPGEVPALSNLRPPSRVDGMVGDDPYNPYKYSDDNPYYNYYDTYERPRPGGRYRPGYGTGYFQYGLPDLVADPYYIQASTYVQKMSMYNLRCAAEENCLASTAYRADVRDYDHRVLLRFPQRVKNQGTSDFLPSRPRYSWEWHSCHQHYHSMDEFSHYDLLDANTQRRVAEGHKASFCLEDTSCDYGYHRRFACTAHTQGLSPGCYDTYGADIDCQWIDITDVKPGNYILKVSVNPSYLVPESDYTNNVVRCDIRYTGHHAYASGCTISPY

SEQ ID NO: 76 - protein, 574 aa, Homo Sapiens
MALARGSRQLGALVWGACLCVLVHGQQAQPGQGSDPARWRQLIQWENNGQVYSLLNSGSEYVPAGPQRSESSSRVLLAGAPQAQQRRSHGSPRRRQAPSLPLPGRVGSDTVRGQARHPFGFGQVPDNWREVAVGDSTGMALARTSVSQQRHGGSASSVSASAFASTYRQQPSYPQQFPYPQAPFVSQYENYDPASRTYDQGFVYYRPAGGGVGAGAAAVASAGVIYPYQPRARYEEYGGGEELPEYPPQGFYPAPERPYVPPPPPPPDGLDRRYSHSLYSEGTPGFEQAYPDPGPEAAQAHGGDPRLGWYPPYANPPPEAYGPPRALEPPYLPVRSSDTPPPGGERNGAQQGRLSVGSVYRPNQNGRGLPDLVPDPNYVQASTYVQRAHLYSLRCAAEEKCLASTAYAPEATDYDVRVLLRFPQRVKNQGTADFLPNRPRHTWEWHSCHQHYHSMDEFSHYDLLDAATGKKVAEGHKASFCLEDSTCDFGNLKRYACTSHTQGLSPGCYDTYNADIDCQWIDITDVQPGNYILKVHVNPKYIVLESDFTNNVVRCNIHYTGRYVSATNCKIVQS

SEQ ID NO: 77 - protein, 774 aa, Homo Sapiens
MERPLCSHLCSCLAMLALLSPLSLAQYDSWPHYPEYFQQPAPEYHQPQAPANVAKIQLRLAGQKRKHSEGRVEVYYDGQWGTVCDDDFSIHAAHVVCRELGYVEAKSWTASSSYGKGEGPIWLDNLHCTGNEATLAACTSNGWGVTDCKHTEDVGVVCSDKRIPGFKFDNSLINQIENLNIQVEDIRIRAILSTYRKRTPVMEGYVEVKEGKTWKQICDKHWTAKNSRVVCGMFGFPGERTYNTKVYKMFASRRKQRYWPFSMDCTGTEAHISSCKLGPQVSLDPMKNVTCENGLPAVVSCVPGQVFSPDGPSRFRKAYKPEQPLVRLRGGAYIGEGRVEVLKNGEWGTVCDDKWDLVSASVVCRELGFGSAKEAVTGSRLGQGIGPIHLNEIQCTGNEKSIIDCKFNAESQGCNHEEDAGVRCNTPAMGLQKKLRLNGGRNPYEGRVEVLVERNGSLVWGMVCGQNWGIVEAMVVCRQLGLGFASNAFQETWYWHGDVNSNKVVMSGVKCSGTELSLAHCRHDGEDVACPQGGVQYGAGVACSETAPDLVLNAEMVQQTTYLEDRPMFMLQCAMEENCLSASAAQTDPTTGYRRLLRFSSQIHNNGQSDFRPKNGRHAWIWHDCHRHYHSMEVFTHYDLLNLNGTKVAEGHKASFCLEDTECEGDIQKNYECANFGDQGITMGCWDMYRHDIDCQWVDITDVPPGDYLFQVVINPNFEVAESDYSNNIMKCRSRYDGHRIWMYNCHIGGSFSEETEKKFEHFSGLLNNQLSPQ

SEQ ID NO: 78 - protein, 754 aa, Mus Musculus
MRAVSVWYCCPWGLLLLHCLCSFSVGSPSPSISPEKKVGSQGLRFRLAGFPRKPYEGRVEIQRAGEWGTICDDDFTLQAAHVLCRELGFTEATGWTHSAKYGPGTGRIWLDNLSCRGTEGSVTECASRGWGNSDCTHDEDAGVICKDQRLPGFSDSNVIEVEHQLQVEEVRLRPAVEWGRRPLPVTEGLVEVRLPEGWSQVCDKGWSAHNSHVVCGMLGFPGEKRVNMAFYRMLAQKKQHSFGLHSVACVGTEAHLSLCSLEFYRANDTTRCSGGNPAVVSCVLGPLYATFTGQKKQQHSKPQGEARVRLKGGAHQGEGRVEVLKAGTWGTVCDRKWDLQAASVVCPELGFGTAREALSGARMGQGMGAIHLSEVRCSGQEPSLWRCPSKNITAEDCSHSQDAGVRCNLPYTGVETKIRLSGGRSRYEGRVEVQIGIPGHLRWGLICGDDWGTLEAMVACRQLGLGYANHGLQETWYWDSGNVTEVVMSGVRCTGSELSLNQCAHHSSHITCKKTGTRFTAGVICSETASDLLLHSALVQETAYIEDRPLHMLYCAAEENCLASSARSANWPYGHRRLLRFSSQIHNLGRADFRPKAGRHSWVWHECHGHYHSMDIFTHYDILTPNGTKVAEGHKASFCLEDTECQEDVSKRYECANFGEQGITVGCWDLYRHDIDCQWIDITDVKPGNYILQVVINPNFEVAESDFTNNAMKCNCKYDGHRIWVHNCHIGDAFSEEANRRFERYPGQTSNQIV

SEQ ID NO: 79 - protein, 11 aa, Artificial Sequence
  Copper talon consensus sequence
WEWHSCHQHYH

SEQ ID NO: 80 - protein, 451 aa, Homo Sapiens
MEQWDHFHNQQEDTDSCSESVKFDARSMTALLPPNPKNSPSLQEKLKSFKAALIALYLLVFAVLIPLIGIVAAQLLKWETKNCSVSSTNANDITQSLTGKGNDSEEEMRFQEVFMEHMSNMEKRIQHILDMEANLMDTEHFQNFSMTTDQRFNDILLQLSTLFSSVQGHGNAIDEISKSLISLNTTLLDLQLNIENLNGKIQENTFKQQEEISKLEERVYNVSAEIMAMKEEQVHLEQEIKGEVKVLNNITNDLRLKDWEHSQTLRNITLIQGPPGPPGEKGDRGPTGESGPRGFPGPIGPPGLKGDRGAIGFPGSRGLPGYAGRPGNSGPKGQKGEKGSGNTLTPFTKVRLVGGSGPHEGRVEILHSGQWGTICDDRWEVRVGQVVCRSLGYPGVQAVHKAAHFGQGTGPIWLNEVFCFGRESSIEECKIRQWGTRACSHSEDAGVTCTL

SEQ ID NO: 81 - DNA, 24 bp, Artificial Sequence
  Primer
gcttaccaagaaacccatgtcagc

SEQ ID NO: 82 - DNA, 20 bp, Artificial Sequence
  Primer
ggcagttagtcaggtgctgc

SEQ ID NO: 83 - protein, 4 aa, Artificial Sequence
  Consensus sequence
  VARIANT (3)...(3): Xaa = S or T
  VARIANT (1)...(4): Xaa = Any Amino Acid
NPXP

SEQ ID NO: 84 - protein, 3 aa, Artificial Sequence
  Consensus sequence
  VARIANT (1)...(1): Xaa = S or T
  VARIANT (2)...(2): Xaa = Any amino acid
  VARIANT (3)...(3): Xaa = R or K
  VARIANT (1)...(3): Xaa = Any Amino Acid
XXX

SEQ ID NO: 85 - protein, 4 aa, Artificial Sequence
  Consensus sequence
  VARIANT (1)...(1): Xaa = S or T
  VARIANT (2)...(3): Xaa = Any amino acid
  VARIANT (4)...(4): Xaa = D or E
  VARIANT (1)...(4): Xaa = Any Amino Acid
XXXX

SEQ ID NO: 86 - protein, 6 aa, Artificial Sequence
  Consensus sequence
  VARIANT (2)...(2): Xaa = E, D, R, K, H, P, F, Y or W
  VARIANT (3)...(4): Xaa = Any amino acid
  VARIANT (5)...(5): Xaa = S, T, A, G, C or N
  VARIANT (1)...(6): Xaa = Any Amino Acid
GXXXXP

SEQ ID NO: 87 - protein, 4 aa, Artificial Sequence
  Consensus sequence
  VARIANT (1)...(1): Xaa = Any amino acid
  VARIANT (3)...(4): Xaa = R or K
  VARIANT (1)...(4): Xaa = Any Amino Acid
XGXX

SEQ ID NO: 88 - DNA, 2987 bp, Homo Sapiens
  CDS (20)...(2089)
accactgcggccaccgccaatgaaacgcctcccgctcctagtggttttttccactttgttgaattgttcctatactcaaaattgcaccaagacaccttgtctcccaaatgcaaaatgtgaaatacgcaatggaattgaagcctgctattgcaacatgggattttcaggaaatggtgtcacaatttgtgaagatgataatgaatgtggaaatttaactcagtcctgtggcgaaaatgctaattgcactaacacagaaggaagttattattgtatgtgtgtacctggcttcagatccagcagtaaccaagacaggtttatcactaatgatggaaccgtctgtatagaaaatgtgaatgcaaactgccatttagataatgtctgtatagctgcaaatattaataaaactttaacaaaaatcagatccataaaagaacctgtggctttgctacaagaagtctatagaaattctgtgacagatctttcaccaacagatataattacatatatagaaatattagctgaatcatcttcattactaggttacaagaacaacactatctcagccaaggacaccctttctaactcaactcttactgaatttgtaaaaaccgtgaataattttgttcaaagggatacatttgtagtttgggacaagttatctgtgaatcataggagaacacatcttacaaaactcatgcacactgttgaacaagctactttaaggatatcccagagcttccaaaagaccacagagtttgatacaaattcaacggatatagctctcaaagttttcttttttgattcatataacatgaaacatattcatcctcatatgaatatggatggagactacataaatatatttccaaagagaaaagctgcatatgattcaaatggcaatgttgcagttgcatttttatattataagagtattggtcctttgctttcatcatctgacaacttcttattgaaacctcaaaattatgataattctgaagaggaggaaagagtcatatcttcagtaatttcagtctcaatgagctcaaacccacccacattatatgaacttgaaaaaataacatttacattaagtcatcgaaaggtcacagataggtataggagtctatgtgcattttggaattactcacctgataccatgaatggcagctggtcttcagagggctgtgagctgacatactcaaatgagacccacacctcatgccgctgtaatcacctgacacattttgcaattttgatgtcctctggtccttccattggtattaaagattataatattcttacaaggatcactcaactaggaataattatttcactgatttgtcttgccatatgcatttttaccttctggttcttcagtgaaattcaaagcaccaggacaacaattcacaaaaatctttgctgtagcctatttcttgctgaacttgtttttcttgttgggatcaatacaaatactaataagctcttctgttcaatcattgccggactgctacactacttctttttagctgcttttgcatggatgtgcattgaaggcatacatctctatctcattgttgtgggtgtcatctacaacaagggatttttgcacaagaatttttatatctttggctatctaagcccagccgtggtagttggattttcggcagcactaggatacagatattatggcacaaccaaagtatgttggcttagcaccgaaaacaactttatttggagttttataggaccagcatgcctaatcattcttggtaatctcttggcttttggagtcatcatatacaaagtttttcgtcacactgcagggttgaaaccagaagttagttgctttgagaacataaggtcttgtgcaagaggagccctcgctcttctggtccttctcggcaccacctggatctttgggggtctccatgttgtgcacgcatcagtggttacagcttacctcttcacagtcagcaatgctttccaggggatgttcatttttttattcctgtgtgttttatctagaaagattcaagaagaatattacagattgttcaaaaatgtcccctgttgttttggatgtttaaggtaaacatagagaatggtggataattacaactgcacaaaaataaaaattccaagctgtggatgaccaatgtataaaaatgactcatcaaattatccaattattaactactagacaaaaagtattttaaatcagtttttctgtttatgctataggaactgtagataataaggtaaaattatgtatcatatagatatactatgtttttctatgtgaaatagttctgtcaaaaatagtattgcagatatttggaaagtaattggtttctcaggagtgatatcactgcacccaaggaaagattttctttctaacacgagaagtatatgaatgtcctgaaggaaaccactggcttgatatttctgtgactcgtgttgcctttgaaactagtcccctaccacctcggtaatgagctccattacagaaagtggaacataagagaatgaaggggcagaatatcaaacagtgaaaagggaatgataagatgtattttgaatgaactgttttttctgtagactagctgagaaattgttgacataaaataaagaattgaagaaacacattttaccattttgtgaattgttctgaacttaaatgtccactaaaacaacttagacttctgtttgctaaatctgtttctttttctaatattctaaaaaaaacaaaaaggtttacctccacaaattgaaaaaaaaaaagtgaaaaaaatctgtttctaaggttagactgagatatatactatttccttacttatttcacagattgtgactttggatagttaatcagtaaaatataaatgtgtcaagatataatattgtttatacctatcaatgtaaaaacagtgtaataaagctgaagtattctattaaaaaaaaaaaaaaaaaaaaaaaaaaagggcggccgc

SEQ ID NO: 89 - protein, 690 aa, Homo Sapiens
MKRLPLLVVFSTLLNCSYTQNCTKTPCLPNAKCEIRNGIEACYCNMGFSGNGVTICEDDNECGNLTQSCGENANCTNTEGSYYCMCVPGFRSSSNQDRFITNDGTVCIENVNANCHLDNVCIAANINKTLTKIRSIKEPVALLQEVYRNSVTDLSPTDIITYIEILAESSSLLGYKNNTISAKDTLSNSTLTEFVKTVNNFVQRDTFVVWDKLSVNHRRTHLTKLMHTVEQATLRISQSFQKTTEFDTNSTDIALKVFFFDSYNMKHIHPHMNMDGDYINIFPKRKAAYDSNGNVAVAFLYYKSIGPLLSSSDNFLLKPQNYDNSEEEERVISSVISVSMSSNPPTLYELEKITFTLSHRKVTDRYRSLCAFWNYSPDTMNGSWSSEGCELTYSNETHTSCRCNHLTHFAILMSSGPSIGIKDYNILTRITQLGIIISLICLAICIFTFWFFSEIQSTRTTIHKNLCCSLFLAELVFLVGINTNTNKLFCSIIAGLLHYFFLAAFAWMCIEGIHLYLIVVGVIYNKGFLHKNFYIFGYLSPAVVVGFSAALGYRYYGTTKVCWLSTENNFIWSFIGPACLIILGNLLAFGVIIYKVFRHTAGLKPEVSCFENIRSCARGALALLVLLGTTWIFGGLHVVHASVVTAYLFTVSNAFQGMFIFLFLCVLSRKIQEEYYRLFKNVPCCFGCLR

SEQ ID NO: 90 - DNA, 2073 bp, Homo Sapiens
  CDS (1)...(2073)
atgaaacgcctcccgctcctagtggttttttccactttgttgaattgttcctatactcaaaattgcaccaagacaccttgtctcccaaatgcaaaatgtgaaatacgcaatggaattgaagcctgctattgcaacatgggattttcaggaaatggtgtcacaatttgtgaagatgataatgaatgtggaaatttaactcagtcctgtggcgaaaatgctaattgcactaacacagaaggaagttattattgtatgtgtgtacctggcttcagatccagcagtaaccaagacaggtttatcactaatgatggaaccgtctgtatagaaaatgtgaatgcaaactgccatttagataatgtctgtatagctgcaaatattaataaaactttaacaaaaatcagatccataaaagaacctgtggctttgctacaagaagtctatagaaattctgtgacagatctttcaccaacagatataattacatatatagaaatattagctgaatcatcttcattactaggttacaagaacaacactatctcagccaaggacaccctttctaactcaactcttactgaatttgtaaaaaccgtgaataattttgttcaaagggatacatttgtagtttgggacaagttatctgtgaatcataggagaacacatcttacaaaactcatgcacactgttgaacaagctactttaaggatatcccagagcttccaaaagaccacagagtttgatacaaattcaacggatatagctctcaaagttttcttttttgattcatataacatgaaacatattcatcctcatatgaatatggatggagactacataaatatatttccaaagagaaaagctgcatatgattcaaatggcaatgttgcagttgcatttttatattataagagtattggtcctttgctttcatcatctgacaacttcttattgaaacctcaaaattatgataattctgaagaggaggaaagagtcatatcttcagtaatttcagtctcaatgagctcaaacccacccacattatatgaacttgaaaaaataacatttacattaagtcatcgaaaggtcacagataggtataggagtctatgtgcattttggaattactcacctgataccatgaatggcagctggtcttcagagggctgtgagctgacatactcaaatgagacccacacctcatgccgctgtaatcacctgacacattttgcaattttgatgtcctctggtccttccattggtattaaagattataatattcttacaaggatcactcaactaggaataattatttcactgatttgtcttgccatatgcatttttaccttctggttcttcagtgaaattcaaagcaccaggacaacaattcacaaaaatctttgctgtagcctatttcttgctgaacttgtttttcttgttgggatcaatacaaatactaataagctcttctgttcaatcattgccggactgctacactacttctttttagctgcttttgcatggatgtgcattgaaggcatacatctctatctcattgttgtgggtgtcatctacaacaagggatttttgcacaagaatttttatatctttggctatctaagcccagccgtggtagttggattttcggcagcactaggatacagatattatggcacaaccaaagtatgttggcttagcaccgaaaacaactttatttggagttttataggaccagcatgcctaatcattcttggtaatctcttggcttttggagtcatcatatacaaagtttttcgtcacactgcagggttgaaaccagaagttagttgctttgagaacataaggtcttgtgcaagaggagccctcgctcttctggtccttctcggcaccacctggatctttgggggtctccatgttgtgcacgcatcagtggttacagcttacctcttcacagtcagcaatgctttccaggggatgttcatttttttattcctgtgtgttttatctagaaagattcaagaagaatattacagattgttcaaaaatgtcccctgttgttttggatgtttaaggtaa

SEQ ID NO: 91 - protein, 425 aa, Homo Sapiens
MGPRRLLLVAACFSLCGPLLSARTRARRPESKATNATLDPRSFLLRNPNDKYEPFWEDEEKNESGLTEYRLVSINKSSPLQKQLPAFISEDASGYLTSSWLTLFVPSVYTGVFVVSLPLNIMAIVVFILKMKVKKPAVVYMLHLATADVLFVSVLPFKISYYFSGSDWQFGSELCRFVTAAFYCNMYASILLMTVISIDRFLAVVYPMQSLSWRTLGRASFTCLAIWALAIAGVVPLVLKEQTIQVPGLNITTCHDVLNETLLEGYYAYYFSAFSAVFFFVPLIISTVCYVSIIRCLSSSAVANRSKKSRALFLSAAVFCIFIICFGPTNVLLIAHYSFLSHTSTTEAAYFAYLLCVCVSSISSCIDPLIYYYASSECQRYVYSILCCKESSDPSSYNSSGQLMASKMDTCSSNLNNSIYKKLLT

SEQ ID NO: 92 - protein, 348 aa, Homo Sapiens [sequence omitted]

SEQ ID NO: 93 - protein, 460 aa, Rattus norvegicus
MNTSVPPAVSPNITVLAPGKGPWQVAFIGITTGLLSLATVTGNLLVLISFKVNTELKTVNNYFLLSLACADLIIGTFSMNLYTTYLLMGHWALGTLACDLWLALDYVASNASVMNLLLISFDRYFSVTRPLSYRAKRTPRRAALMIGLAWLVSFVLWAPAILFWQYLVGERTVLAGQCYIQFLSQPIITFGTAMAAFYLPVTVMCTLYWRIYRETENRARELAALQGSETPGKGGGSSSSSERSQPGAEGSPESPPGRCCRCCRAPRLLQAYSWKEEEEEDEGSMESLTSSEGEEPGSEVVIKMPMVDSEAQAPTKQPPKSSPNTVKRPTKKGRDRGGKGQKPRGKEQLAKRKTFSLVKEKKAARTLSAILLAFILTWTPYNIMVLVSTFCKDCVPETLWELGYWLCYVNSTVNPMCYALCNKAFRDTFRLLLLCRWDKRRWRKIPKRPGSVHRTPSRQC

SEQ ID NO: 94 - protein, 350 aa, Homo Sapiens [sequence omitted]

SEQ ID NO: 95 - protein, 601 aa, Drosophila melanogaster
MPSADQILFVNVTTTVAAAALTAAAAVSTTKSGNGNAARGYTDSDDDAGMGTEAVANISGSLVEGLTTVTAALSTAQADKDSAGECEGAVEELHASILGLQLAVPEWEALLTALVLSVIIVLTIIGNILVILSVFTYKPLRIVQNFFIVSLAVADLTVALLVLPFNVAYSILGRWEFGIHLCKLWLTCDVLCCTSSILNLCAIALDRYWAITDPINYAQKRTVGRVLLLISGVWLLSLLISSPPLIGWNDWPDEFTSATPCELTSQRGYVIYSSLGSFFIPLAIMTIVYIEIFVATRRRLRERARANKLNTIALKSTELEPMANSSPVAASNSGSKSRLLASWLCCGRDRAQFATPMIQNDQESISSETHQPQDSSKAGPHGNSDPQQQHVVVLVKKSRRAKTKDSIKHGKTRGGRKSQSSSTCEPHGEQQLLPAGGDGGSCQPGGGHSGGGKSDAEISTESGSDPKGCIQVCVTQADEQTSLKLTPPQSSTGVAAVSVTPLQKKTSGVNQFIEEKQKISLSKERRAARTLGIIMGVFVICWLPFFLMYVILPFCQTCCPTNKFKNFITWLGYINSGLNPVIYTIFNLDYRRAFKRLLGLN

SEQ ID NO: 96 - protein, 258 aa, Homo Sapiens
IKDYNILTRITQLGIIISLICLAICIFTFWFFSEIQSTRTTIHKNLCCSLFLAELVFLVGINTNTNKLFCSIIAGLLHYFFLAAFAWMCIEGIHLYLIVVGVIYNKGFLHKNFYIFGYLSPAVVVGFSAALGYRYYGTTKVCWLSTENNFIWSFIGPACLIILGNLLAFGVIIYKVFRHTAGLKPEVSCFENIRSCARGALALLLLGTTWIFGGLHVVHASVVTAYLFTVSNAFQGMFIFLFLCVLSRKIQEEYYRLF

SEQ ID NO: 97 - protein, 176 aa, Artificial Sequence
  Consensus sequence
  VARIANT (1)...(4): Xaa = any amino acid
  VARIANT (6)...(54): Xaa at positions 6-54 may be absent; intended a range of 0-48 amino acids
  VARIANT (56)...(67): Xaa at positions 56-67 may be absent; intended to equal a range of 3-12 amino acids
  VARIANT (69)...(138): Xas at positions 69-138 may be absent; intended to equal a range of 1-70 amino acids
  VARIANT (140)...(145): Xaa at positions 140-145 may be absent; intended to equal a range of 1-6 amino acids
  VARIANT (147)...(148): Xaa = Any amino acid
  VARIANT (151)...(171): Xaa at positions 151-171 may be absent; intended to equal a range of 0-21 amino acids
  VARIANT (173)...(174): Xaa = Any amino acid
  VARIANT (176)...(176): Xaa = Any amino acid
XXXXCXXXXXXXXXXXXXXXXXXXXXXXXXXXXXXXXXXXXXXXXXXXXXXXXXCXXXXXXXXXXXXCXXXXXXXXXXXXXXXXXXXXXXXXXXXXXXXXXXXXXXXXXXXXXXXXXXXXXXXXXXXXXXXXXXXXXXCXXXXXXCXXGAXXXXXXXXXXXXXXXXXXXXXGXXCX

SEQ ID NO: 98 - protein, 12 aa, Artificial Sequence
  Consensus sequence
  VARIANT (2)...(2): Xaa = Any amino acid
  VARIANT (4)...(8): Xaa = Any amino acid
  VARIANT (10)...(11): Xaa = Any amino acid
  VARIANT (1)...(12): Xaa = Any Amino Acid
CXCXXXXXGXXC

SEQ ID NO: 99 - protein, 16 aa, Artificial Sequence
  Consensus sequence
  VARIANT (2)...(2): Xaa = Any amino acid
  VARIANT (4)...(5): Xaa = Any amino acid
  VARIANT (6)...(6): Xaa = Gly or Pro
  VARIANT (7)...(7): Xaa = Phe, Tyr or Trp
  VARIANT (8)...(15): Xaa at positions 8-15 may be absent; intended to equal a range of 8-15 amino acids
CXCXXXXXXXXXXXXC

SEQ ID NO: 100 - protein, 71 aa, Homo Sapiens
CTKTPCLPNAKCEIRNGIEACYCNMGFSGNGVCGNLTQSCGENANCTNTEGSYYCMCVPGFRSSSNQDRFI

SEQ ID NO: 101 - protein, 43 aa, Homo Sapiens
LVFLVGINTNTNKLFCSIIAGLLHYFFLAAFAWMCIEGIHLYL

SEQ ID NO: 102 - protein, 835 aa, Homo Sapiens [sequence omitted]

SEQ ID NO: 103 - DNA, 3156 bp, Homo Sapiens
ctgtcccactcactctttcccctgccgctcctgccggcagctccaaccatgggaggccgcgtctttctcgcattctgtgtctggctgactctgccgggagctgaaacccaggactccaggggctgtgcccggtggtgccctcagaactcctcgtgtgtcaatgccaccgcctgtcgctgcaatccagggttcagctctttttctgagatcatcaccaccccgacggagacttgtgacgacatcaacgagtgtgcaacaccgtcgaaagtgtcatgcggaaaattctcggactgctggaacacagaggggagctacgactgcgtgtgcagcccgggatatgagcctgtttctgggacaaaaacattcaagaatgagagcgagaacacctgtcaagatgtggacgaatgtcagcagaacccaaggctctgtaaaagctacggcacctgcgtcaacacccttggcagctatacctgccagtgcctgcctggcttcaagttcatacctgaggatccgaaggtctgcacagatgtgaatgaatgcacctccggacaaaatccgtgccacagctccacccactgcctcaacaacgtgggcagctatcagtgtcgctgccgaccgggctggcaaccgattccggggtcccccaatggcccaaacaataccgtctgtgaagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaagatatgactttctccacctggaccccgccccctggagtccacagccagacgctttcccgattcttcgacaaagtccaggacctgggcagagactccaagacaagctcagccgaggtcaccatccagaatgtcatcaaattggtggatgaactgatggaagctcctggagacgtagaggccctggcgccacctgtccggcacctcatagccacccagctgctctcaaaccttgaagatatcatgaggatcctggccaagagcctgcctaaaggccccttcacctacatttccccttcgaacacagagctgaccctgatgatccaggagcggggggacaagaacgtcactatgggtcagagcagcgcacgcatgaagctgaattgggctgtggcagctggagccgaggatccaggccccgccgtggcgggcatcctctccatccagaacatgacgacattgctggccaatgcctccttgaacctgcattccaagaagcaagccgaactggaggagatatatgaaagcagcatccgtggtgtccaactcagacgcctctctgccgtcaactccatctttctgagccacaacaacaccaaggaactcaactcccccatccttttcgccttctcccaccttgagtcctccgatggggaggcgggaagagaccctcctgccaaggacgtgatgcctgggccacggcaggagctgctctgtgccttctggaagagtgacagcgacaggggagggcactgggccaccgagggctgccaggtgctgggcagcaagaacggcagcaccacctgccaatgcagccacctgagcagctttgcgatccttatggctcattatgacgtggaggactggaagctgaccctgatcaccagggtgggactggcgctgtcactcttctgcctgctgctgtgcatcctcactttcctgctggtgcggcccatccagggctcgcgcaccaccatacacctgcacctctgcatctgcctcttcgtgggctccaccatcttcctggccggcatcgagaacgaaggcggccaggtggggctgcgctgccgcctggtggccgggctgctgcactactgtttcctggccgccttctgctggatgagcctcgaaggcctggagctctactttcttgtggtgcgcgtgttccaaggccagggcctgagtacgcgctggctctgcctgatcggctatggcgtgcccctgctcatcgtgggcgtctcggctgccatctacagcaagggctacggccgccccagatactgctggttggactttgagcagggcttcctctggagcttcttgggacctgtgaccttcatcattttgtgcaatgctgtcattttcgtgactaccgtctggaagctcactcagaagttttctgaaatcaatccagacatgaagaaattaaagaaggcgagggcgctgaccatcacggccatcgcgcagctcttcctgttgggctgcacctgggtctttggcctgttcatcttcgacgatcggagcttggtgctgacctatgtgtttaccatcctcaactgcctgcagggcgccttcctctacctgctgcactgcctgctcaacaagaaggttcgggaagaataccggaagtgggcctgcctagttgctggggggagcaagtactcagaattcacctccaccacgtctggcactggccacaatcagacccgggccctcagggcatcagagtccggcatatgaaggcgcatggttctggacggcccagcagctcctgtggccacagcagctttgtacacgaagaccatccatcctcccttcgtccaccactctactccctccaccctccctccctgatcccgtgtgccaccaggagggagtggcagctatagtctggcaccaaagtccaggacacccagtggggtggagtcggagccactggtcctgctgctggctgcctctctgctccaccttgtgacccagggtggggacaggggctggcccagggctgcaatgcagcatgttgccctggcacctgtggccagtactcgggacagactaagggcgcttgtcccatcctggacttttcctctcatgtctttgctgcagaactgaagagactaggcgctggggctcagcttccctcttaagctaagactgatgtcagaggccccatggcgaggccccttggggccactgcctgaggctcacggtacagaggcctgccctgcctggccgggcaggaggttctcactgttgtgaaggttgtagacgttgtgtaatgtgtttttatctgttaaaatttttcagtgttgacacttaaaattaaacacatgcatacag

SEQ ID NO: 104 - DNA, 3952 bp, Mus Musculus
  CDS (70)...(2136)
ccgaaattcccgggtcgacccacgcgtccgctagcctagagcgctctgccgccagctccggggcttccaatgagactcctcccgcttctagtgggtttctccactttgctgaattgttcctacacacaaaactgcagcaagacaacgtgtctccccaatgccaagtgcgaagtgcacaatggtgtggaagcctgcttctgcagccaggggtactctgggaatggcgtcacgatttgtgaagatatagatgagtgcagcgagtcttctgtctgcggtgatcatgctgtgtgtgaaaacgtgaacgggggcttcagctgcttctgcagggaaggttatcagaccgccacggggaagtcacagttcacacctaatgatggctcttactgccaagaaagcatgaattcaaattgccgcttagagtatgcctgcatcgctacaaacattagtaaaactttaaaaagaattggacccataacagaacagacaactttactccaagaaatctacagaaattctgaggctgagctctctctgatggatatagtcacatacatagagatcctaactgaatcatcctcactactaggccacccgaacagcaccacttcatacaaggatgcccacttcaactcaacccttactgaatttggggaaaccatcaataattttgttgaaaggagtacacataaaatgtgggaccagttaccgacaaatcacagaagacttcatctcacaaaactgatgcacactgctgagctagtcaccttacagatcgctcagaacatccagaagaattctcagtttgatatgaattctactgacttggctctcaaggtttttgcttttgattcaactcacatgaagcatgctcacccccacatgaatgtggatggaggctatgtgaaaatatccccaaggagaaaggctgcacatggcacaactggcaatgtagtagttgcattcctctgctataagagcattggtcccttgctatcctcatctgacaacttcttactggacactcaaaatgataattctgaaggaaaggaaaaagtcatttcttcagtgatttctgcctcaattagctcaaatccacccacattatatgaacttgaaaaaattacatttacactaagtcatgtaaagctctcagataagcaccggacccagtgcgccttttggaactactcagttgatgccatgaacaatggcagctggtcaacggagggctgtgagctgacacactcaaacgacacccacacctcctgccgctgtagtcacctgacacactttgcgattttgatgtcctctacttcttccattgggattaaggattataatatcctgacgaggatcactcaactcgggataatcatctccctgatctgcctcgccatctgcatcttcaccttctggttcttcagtgaaatccaaagcaccaggacctcgattcacaagaacctgtgctgcagcctctttcttgcagaacttgtttttcttattgggatcaacataaatacgaataagttggtctgctctatcattgctggcctgctccattacttcttcttagctgcctttgcctggatgtgcatcgaaggcattcacctatacctcatcgttgtcggcgtcatctacaacaaggggtttttacacaagaacttttatatctttggctatctcagcccagctgtagttgttggattctcagcatctttaggatacagatattatggaaccacgaaagtatgttggctgagcactgaaaacaacttcatttggagctttataggaccagcgtgtctaatcattcttgtgaatctcttggcttttggagttatcatatacaaagttttccgccacactgctggactgaaaccagaagttagttgctatgagaacataaggtcttgtgccagaggtgccctagccctcctcttccttctgggtaccacctggatctttggggttctccatgtagtgcatgcatctgttgtgacagcctacctcttcacagtcagcaatgctttccaagggatgttcattttcttattcctatgcgttttgtctagaaagattcaagaggaatattatagattgttcaaaaatgtcccctgctgctttggatgtttaagataaacaatgagaagtcatgataattacagctgcaatgagatgaaaattccaagattcagataacctgtgtggcaaaaaatgagcctgtttttattgttagtaattaatttcaaatccatttttctgttcacagtataagagatgtagttaatgtgagataaaattatggaccagagagctacagtgtgttttcttacatgacatagttagagatatgtcaaaaatagtactgcagatatttggaaagtaattggtttctctggagtgatatcactgtgcccaaggaaagatttctttctaacacgagaaatatatgaatgtcctcaaggaaaccactggcttgatatctttgtgactcatgttgcctttcaaacgagttccctaccaccttagtaatgagttcctttgcaggaaggagagcataagagacgtggaggggcagagtatgaagcagtgacgaaggcttctctgacaaggaattgtcattccaataaactcagcttctctaaacttgatgagaaaatctcaagataaaataacgagaaaggaaatatatcctagcagtttgggaattggtctgaagtaaaaagccccagatctaaatttgctacatccatgttcttccttactcttctaaaaccagagaaaagccttacaactgacattatcagagatggatgctcttacactaacattagatttgagtgtaaaatgttttcattccacacagattaagacttcaaatatgtagtcagtaaaacatagatttgtcaaagtataatactgtttatgtctttagtgaaaagaatgtgtgcagtattttgtctataatattttactgttatgaaaattaccttttaatattaaatcagtatacttgaatactttgctgtttttaatcttacaaatagtgtaattcatgttgcaacaggcccttttaattgactgtacataaaaggtcattataaatttaaagtattgatgaagtgaattataattcttttctgatcagaaaatacacaattaaagcattatttataacaaataagaagtcactgagtgctgtaggggtttcacagtgggtctagttttagactgtttctactatctctcaaagtctattggctcaaatgtatggctctatctattctcttgttcaaatgaagaggcagattttttttcagaagtgagtcattgttctgaaccttcctgaaagcataattcaatctactggacattgcaattttaattcttgtgctgttgaatgaagcctgtcgagacctctcctgaaaaatgaacagtcagctggatgaagcagccctatcgctgcctgaccgagttgttctctcaggagagaccactcacctgtcaagaagggctttgcatttctagagcctgtgagatggtacactttgactaaatctctggatttcttctgtgctaagtctgtggcccatgactgccattgtcattctgggttgggactgtagaaataggatatcaaaacctagtctgctcaatcagtggatatgaaactattgcacgtggtagacagagtgaccctccacaaatatctgtacgctcctcttcagagcctgtggctgtggtggatggcgaggagcaggagggccctgtggggagggagggtagctgacctccactcagttggagcactctcactaccctgagggaagtcagcatgctgctgatgtatttcagtgtgggtctcctggtttggaactctcatttctagagctacaagacaataaaattctattatcaaagccaaaaaaaaaaaaaaaaaaaaaaaaaaaaa

SEQ ID NO: 105 - protein, 689 aa, Mus Musculus
MRLLPLLVGFSTLLNCSYTQNCSKTTCLPNAKCEVHNGVEACFCSQGYSGNGVTICEDIDECSESSVCGDHAVCENVNGGFSCFCREGYQTATGKSQFTPNDGSYCQESMNSNCRLEYACIATNISKTLKRIGPITEQTTLLQEIYRNSEAELSLMDIVTYIEILTESSSLLGHPNSTTSYKDAHFNSTLTEFGETINNFVERSTHKMWDQLPTNHRRLHLTKLMHTAELVTLQIAQNIQKNSQFDMNSTDLALKVFAFDSTHMKHAHPHMNVDGGYVKISPRRKAAHGTTGNVVVAFLCYKSIGPLLSSSDNFLLDTQNDNSEGKEKVISSVISASISSNPPTLYELEKITFTLSHVKLSDKHRTQCAFWNYSVDAMNNGSWSTEGCELTHSNDTHTSCRCSHLTHFAILMSSTSSIGIKDYNILTRITQLGIIISLICLAICIFTFWFFSEIQSTRTSIHKNLCCSLFLAELVFLIGININTNKLVCSIIAGLLHYFFLAAFAWMCIEGIHLYLIVVGVIYNKGFLHKNFYIFGYLSPAVVVGFSASLGYRYYGTTKVCWLSTENNFIWSFIGPACLIILVNLLAFGVIIYKVFRHTAGLKPEVSCYENIRSCARGALALLFLLGTTWIFGVLHVVHASVVTAYLFTVSNAFQGMFIFLFLCVLSRKIQEEYYRLFKNVPCCFGCLR

SEQ ID NO: 106 - DNA, 2070 bp, Mus Musculus
  CDS (1)...(2070)
atgagactcctcccgcttctagtgggtttctccactttgctgaattgttcctacacacaaaactgcagcaagacaacgtgtctccccaatgccaagtgcgaagtgcacaatggtgtggaagcctgcttctgcagccaggggtactctgggaatggcgtcacgatttgtgaagatatagatgagtgcagcgagtcttctgtctgcggtgatcatgctgtgtgtgaaaacgtgaacgggggcttcagctgcttctgcagggaaggttatcagaccgccacggggaagtcacagttcacacctaatgatggctcttactgccaagaaagcatgaattcaaattgccgcttagagtatgcctgcatcgctacaaacattagtaaaactttaaaaagaattggacccataacagaacagacaactttactccaagaaatctacagaaattctgaggctgagctctctctgatggatatagtcacatacatagagatcctaactgaatcatcctcactactaggccacccgaacagcaccacttcatacaaggatgcccacttcaactcaacccttactgaatttggggaaaccatcaataattttgttgaaaggagtacacataaaatgtgggaccagttaccgacaaatcacagaagacttcatctcacaaaactgatgcacactgctgagctagtcaccttacagatcgctcagaacatccagaagaattctcagtttgatatgaattctactgacttggctctcaaggtttttgcttttgattcaactcacatgaagcatgctcacccccacatgaatgtggatggaggctatgtgaaaatatccccaaggagaaaggctgcacatggcacaactggcaatgtagtagttgcattcctctgctataagagcattggtcccttgctatcctcatctgacaacttcttactggacactcaaaatgataattctgaaggaaaggaaaaagtcatttcttcagtgatttctgcctcaattagctcaaatccacccacattatatgaacttgaaaaaattacatttacactaagtcatgtaaagctctcagataagcaccggacccagtgcgccttttggaactactcagttgatgccatgaacaatggcagctggtcaacggagggctgtgagctgacacactcaaacgacacccacacctcctgccgctgtagtcacctgacacactttgcgattttgatgtcctctacttcttccattgggattaaggattataatatcctgacgaggatcactcaactcgggataatcatctccctgatctgcctcgccatctgcatcttcaccttctggttcttcagtgaaatccaaagcaccaggacctcgattcacaagaacctgtgctgcagcctctttcttgcagaacttgtttttcttattgggatcaacataaatacgaataagttggtctgctctatcattgctggcctgctccattacttcttcttagctgcctttgcctggatgtgcatcgaaggcattcacctatacctcatcgttgtcggcgtcatctacaacaaggggtttttacacaagaacttttatatctttggctatctcagcccagctgtagttgttggattctcagcatctttaggatacagatattatggaaccacgaaagtatgttggctgagcactgaaaacaacttcatttggagctttataggaccagcgtgtctaatcattcttgtgaatctcttggcttttggagttatcatatacaaagttttccgccacactgctggactgaaaccagaagttagttgctatgagaacataaggtcttgtgccagaggtgccctagccctcctcttccttctgggtaccacctggatctttggggttctccatgtagtgcatgcatctgttgtgacagcctacctcttcacagtcagcaatgctttccaagggatgttcattttcttattcctatgcgttttgtctagaaagattcaagaggaatattatagattgttcaaaaatgtcccctgctgctttggatgtttaagataa

SEQ ID NO: 107 - DNA, 2563 bp, Homo Sapiens
gccatgtaagacatgcctttgcttctctgccaccttccaccatgattgtgaggcctccccagccatgtggaactgtgagcgtcctgaccaccctggagcgtaggttcaacctgcagagcgctgacgtgggtgtgatcgctagcagcttcgagatcgggaacctggcgctcatcctcttcgtgagctacttcggggcacgcgggcaccggccgcgcctgatcggctgcggcggcatcgtcatggcgctgggcgcgctgctgtcggcgctgcccgagttcctgacccaccagtacaagtacgaggcgggcgagatccgctggggcgccgagggccgcgacgtctgcgcagccaacggctcgggcggcgacgaggggcccgaccccgacctcatctgccgcaaccggacggctaccaacatgatgtacttgctgctcattggggcccaggtgctcctgggcatcggtgctacccctgtgcagcccctgggcgtctcctacatcgacgaccacgtgcggaggaaggactcctcgctctatataggaatcctgttcacgatgctggtatttggaccagcctgcgggtttatcctgggctctttctgtaccaaaatctacgtggatgcagtcttcattgacacaagtaacctggacatcactccggacgacccccgctggatcggagcctggtggggtggctttctgctctgcggtgccttactcttcttctcttccctcttgatgtttgggtttccacagtccctgcccccgcactcagaccccgccatggaaagcgagcaggccatgctctccgaaagagaatacgagagacccaagcccagcaacggggtcctgaggcaccccctggagccagacagcagtgcctcctgtttccagcagctgagagtgatcccgaaggtcaccaagcacctgctctcaaaccctgtgttcacctgcatcatcctggccgcctgcatggagattgcagtggtggctggcttcgctgcctttttggggaagtacctggagcagcagtttaacctcaccacctcttctgccaaccagctgcttgggatgactgcgatcccgtgtgcttgtctgggtatcttcctgggaggtcttttggtgaagaagctcagcctgtctgccctgggggccattcggatggccatgctcgtcaacctggtgtccactgcttgctacgtctccttcctcttcctgggctgcgacactggccctgtggctggggttactgttccctatggaaacagcacagcacctggctcagccctggacccctactcgccctgcaataataactgtgaatgccaaaccgattccttcactccagtgtgtggggcagatggcatcacctacctgtctgcctgctttgctggctgcaacagcacgaatctcacgggctgtgcgtgcctcaccaccgtccctgctgagaacgcaaccgtggttcctggaaaatgccccagtcctgggtgccaagaggccttcctcactttcctctgtgtgatgtgtatctgcagcctgatcggtgccatggcacagacaccctcagtcatcatcctcatcaggacagtcagccctgaactcaagtcttacgctttgggagttctttttctcctccttcgtttgttgggcttcatccctccacccctcatcttcggggctggcatcgactccacctgcctgttctggagcacgttctgtggggagcaaggcgcctgcgtcctctacgacaatgtggtctaccgatacctgtatgtcagcatcgccatcgcgctcaaatccttcgccttcatcctgtacaccaccacgtggcagtgcctgaggaaaaactataaacgctacatcaaaaaccacgagggcgggctgagcaccagcacagagtaccaagacattgagactgagaaaacctgccccgaatcacattcaccttcagaagactcctttgtgagaagctgagggcctggccctcttcctcttcctggagagaacagcccaccaccacccacagacctcgcgggcctcacttagcgcgctcctccctgtccgagaacccgagggtccccatgtggattatccagccagtgtgtggtcctttgaggccccaagcgcaggcctgtgatgaggaccaaagaggtgacttatggtcaggagtactccaaacagctctcagagtaggcatctttcctgggtctctaaagagtcatgctgacctggtgtgcaaattcccttccacccatccctctacctcctctggggatggcttgccgacatgctttagaaactcccctcttgggaatgctcctctgactgagggctccaacagctttaatgaaatcagccgagagggtaaaaaccaacctgttgcatagaatggaggggggaaaaagcacatactcaatagatttttgagtgtggtactctgtatttttgcagcatttattttccaaatgagcagtttagaaatatgtgatgtaaagtacatactgtacgtttgctgaaaattatattaaaagcactattttaattcttaaaaaaaaaaaaaaaaa

SEQ ID NO: 108 - protein, 643 aa, Homo Sapiens
MIVRPPQPCGTVSVLTTLERRFNLQSADVGVIASSFEIGNLALILFVSYFGARGHRPRLIGCGGIVMALGALLSALPEFLTHQYKYEAGEIRWGAEGRDVCAANGSGGDEGPDPDLICRNRTATNMMYLLLIGAQVLLGIGATPVQPLGVSYIDDHVRRKDSSLYIGILFTMLVFGPACGFILGSFCTKIYVDAVFIDTSNLDITPDDPRWIGAWWGGFLLCGALLFFSSLLMFGFPQSLPPHSDPAMESEQAMLSEREYERPKPSNGVLRHPLEPDSSASCFQQLRVIPKVTKHLLSNPVFTCIILAACMEIAVVAGFAAFLGKYLEQQFNLTTSSANQLLGMTAIPCACLGIFLGGLLVKKLSLSALGAIRMAMLVNLVSTACYVSFLFLGCDTGPVAGVTVPYGNSTAPGSALDPYSPCNNNCECQTDSFTPVCGADGITYLSACFAGCNSTNLTGCACLTTVPAENATVVPGKCPSPGCQEAFLTFLCVMCICSLIGAMAQTPSVIILIRTVSPELKSYALGVLFLLLRLLGFIPPPLIFGAGIDSTCLFWSTFCGEQGACVLYDNVVYRYLYVSIAIALKSFAFILYTTTWQCLRKNYKRYIKNHEGGLSTSTEYQDIETEKTCPESHSPSEDSFVRS

SEQ ID NO: 109 - DNA, 1939 bp, Homo Sapiens
ttccaccatgattgtgaggcctccccagccatgtggaactgtgagcgtcctgaccaccctggagcgtaggttcaacctgcagagcgctgacgtgggtgtgatcgctagcagcttcgagatcgggaacctggcgctcatcctcttcgtgagctacttcggggcacgcgggcaccggccgcgcctgatcggctgcggcggcatcgtcatggcgctgggcgcgctgctgtcggcgctgcccgagttcctgacccaccagtacaagtacgaggcgggcgagatccgctggggcgccgagggccgcgacgtctgcgcagccaacggctcgggcggcgacgaggggcccgaccccgacctcatctgccgcaaccggacggctaccaacatgatgtacttgctgctcattggggcccaggtgctcctgggcatcggtgctacccctgtgcagcccctgggcgtctcctacatcgacgaccacgtgcggaggaaggactcctcgctctatataggaatcctgttcacgatgctggtatttggaccagcctgcgggtttatcctgggctctttctgtaccaaaatctacgtggatgcagtcttcattgacacaagtaacctggacatcactccggacgacccccgctggatcggagcctggtggggtggctttctgctctgcggtgccttactcttcttctcttccctcttgatgtttgggtttccacagtccctgcccccgcactcagaccccgccatggaaagcgagcaggccatgctctccgaaagagaatacgagagacccaagcccagcaacggggtcctgaggcaccccctggagccagacagcagtgcctcctgtttccagcagctgagagtgatcccgaaggtcaccaagcacctgctctcaaaccctgtgttcacctgcatcatcctggccgcctgcatggagattgcagtggtggctggcttcgctgcctttttggggaagtacctggagcagcagtttaacctcaccacctcttctgccaaccagctgcttgggatgactgcgatcccgtgtgcttgtctgggtatcttcctgggaggtcttttggtgaagaagctcagcctgtctgccctgggggccattcggatggccatgctcgtcaacctggtgtccactgcttgctacgtctccttcctcttcctgggctgcgacactggccctgtggctggggttactgttccctatggaaacagcacagcacctggctcagccctggacccctactcgccctgcaataataactgtgaatgccaaaccgattccttcactccagtgtgtggggcagatggcatcacctacctgtctgcctgctttgctggctgcaacagcacgaatctcacgggctgtgcgtgcctcaccaccgtccctgctgagaacgcaaccgtggttcctggaaaatgccccagtcctgggtgccaagaggccttcctcactttcctctgtgtgatgtgtatctgcagcctgatcggtgccatggcacagacaccctcagtcatcatcctcatcaggacagtcagccctgaactcaagtcttacgctttgggagttctttttctcctccttcgtttgttgggcttcatccctccacccctcatcttcggggctggcatcgactccacctgcctgttctggagcacgttctgtggggagcaaggcgcctgcgtcctctacgacaatgtggtctaccgatacctgtatgtcagcatcgccatcgcgctcaaatccttcgccttcatcctgtacaccaccacgtggcagtgcctgaggaaaaactataaacgctacatcaaaaaccacgagggcgggctgagcaccagcacagagtaccaagacattgagactgagaaaacctgccccgaatcacattcaccttcagaagactcctttgtgagaagctga

SEQ ID NO: 110 - DNA, 50000 bp, Homo Sapiens
gattagagcatgagacagaggaagaattaaaatagtgcttttaatataattttcagcaaacgtacagtatgtactttacatcacatatttctaaactgctcatttggaaaataaacgctgcaaaaatacagagtaccacactcaaaaatctattgagtatgtgctttttcccccctccattctatgcaacaggttggtttttaccctctcggctgatttcattaaagctgttggagccctcagtcagaggagcattcccaagaggggagtttctaaagcatgtcggcaagccatccccagaggaggtagagggatgggtggaagggaatttgcacaccaggtcagcatgactctttagagacccaggaaagatgcctactctgagagctgtttggagtactcctgaccataagtcacctctttggtcctcatcacaggcctgcgcttggggcctcaaaggaccacacactggctggataatccacatggggaccctcgggttctcggacagggaggagcacgctaagtgaggcccgcgaggtctgtgggtggtggagggctgttctctccaggaagaggaagagggccaggccctcagcttctcacaaaggagtcttctgaaggtgaatgtgattcggggcaggttttctcagtctcaatgtcttggtactctgtgcctaaagggggaggagggaagaagagccaagaggaaaaagagatcggtcttttctgcttcacctactgtttgttaggcttatttaatagcatgatggctttgcagtgaagggacaagagtaggcagtcaaaacaataaagtgctgggtttcattccatgtaaccccaagggaccagactctgagcccagagacttttttgaaggccaaatatcctttctgggaaggatatttatctacatgaccaaccccacagccaagcagatgtcggggatgagtaagatgtatcccagtcaataatttatccttatcttatgtaaattactagtgacagaccttgtgttctggggctctaagtgtcactgtacatctctattgaagagattcctgagtgtcacagaaaactgcctggcatcacaatgtcatatttcctcctccagcattcgggacagtttgtttttttgtgtagccacagatattcactgcatgctggctgaaacgatatcctctttggagcaaggtttttaagcctacgccacatttccagaatagatgctgtggcttcattttaaaggtattaaaaacacaactagtctcagtgatgattcacaagctgtgcaggtctcattgattgtgacatgcagctctcctgttcaataggcacaacgaggccacagaagtctctatttatttgtcctctttagactttgacccagagctacaaaggtgacagtttggaaatgtcattcctttcctcgggattgtgaagctgaagcctgagtcctgggcaagttcgagcatccttccttcactctcacaaggcctacgttcttacagtcttgggttccactgaaagacttgggcgtggggagttgggaagggtgggaccgaagtgagagagctggggttcatccctgctcagcagaatgaataagataaaggctgatgaatggctgggaagttcctgctgatgtggctaaggttgaagtaggaaggaggagtgttttgaaaggtttccaacatttaattattaaagtgaaacctagattcctgtgcccataggcaaaactttgcagagattctcacctccaactcctggctcacttctctatgaaacaatagactcctgctaggggtttcccacaggtagacgctctgttggctttgcagaggcttcataagaagctagttccgtgttctaacttcgggggctttgtgttgtagtggaaagagcactggtttaggagtcagatctgtcactggctcctggtggctttataaactagctatgtgatcttagaacggttggatttgctgagctttagttttcagacctgtgaagtggaaaagaatatatacttacctcgtagggctggtgtgagaaggctgctgggagcagtacctgggatcatgaattcacagaacccggcacgtgggtagcaggtgcttaataaaaacatgagcttcctggccccttccctcccttacagtgctggatgggagcaccatctgtgttcagttgggatccttctgtagaacattttgtaaattctatgcttccaattcattttatggccttagattataaaatcaaatggtcttgccaaacatgtctccatgagagcaatcttctataaggttagtgtgagaatcttctataaggttaacgttaagaaaaacatgaatgggatggtaagtgtccacctacagaaagttaaacttccagaaaacttactatgttgttcatttgctcatagcaaaagaacgtaatcaattgtatcttacgggacaaaaattcaaaatttatgataatcaccaactcctgattgttgacctgagtcactattacaaaaatggaaatgtctggatattctgttcctaaaagcctggaatctgagaacagaagacagaacagcaagctagggtggccagtgcatgagtttgaccagggacttgaactcaatatgacaagtgcccctggtctcctctggagaggaagtatatccaattagggaccagcttcggtgtgtttgaagccctggggtcagagctgatctcctgtggttgatgctgtagactacaggggtgccaggcatggcaggtatctggggtctttccgggggagccgatgaccagcactgtggagtgcctccctggcatcttggtgctttgatagtgcatttcggaatgcactaggagtctcctatctgattcctcttatctgtctgtttcaggtaaaatacttcacatcaatggaccactgggatcaggggttagaaggacacacagccccagagcccagctgccatggtgtcctggttgttacatcaggaggcacgtgggagcatgtggggccccacagtccactcgggccagggtcttcttgatcagtgtctaaaggtggggagggaggtccctcgtgtcttacctggtagggaggtagtacccatagtggttatgggtctgtctgggaataaggagagcttttaaagacctaaaagctttttcacagacctgggtttgaatcccaactctgctttgtgaatttgagccaattctggaccttccgagtctcattttcttcccctgtaaaatgaagccaataacagctcctacctcacagggttatggttgagattacatgagctaatacatgaaataagctcagccagcagctggttcatagtcagtgcttgagaaatgttagctactattattagtgcttaccaagtattttacctggcatatctgttaactttagggtgccagtgttttgtgttggttgtggggaggaaaaggattggaaaatactctttggtatctggaatcactcttctttttctagtttgaacatttctccctcatgtgcccatttccatcatttaagagaaaaaggatggtaactctagtcgagctacagtgtcacagctatatgggaatgtagactatacagttcaaatccgccacgtcacacaagagaaaaataatgttgccttcaattttaaccatgagagcaaaggggtacttactttattcttggaaatgagatatctgaattaagagtctcatggtcaggagtgttaaggctgatagacacctagctcagggtcccttcctatgtatgccctggcccatgctacagcagtcttaggtgctgggatctgcctcacctatgctcagccgctagggtcccccaaacatgcagtgctgcttgagaccttgcctgtgcaagagaacagagatcagcacacgatggccttccctcagtcaccgacggtctttgtaaataaagctttattggaacatagcccattggttcacctgttgtctatggctgatctcacagtactacatcagttgagaagttgcaacacagactgcaggcccacaaagtctaaaatgtttactacttggcccattagagaaaaaacttgtgaatgttttggtggcgctctctctgggggcaattctgccctcctcttctcaccctgcttccccaaaagtcacccactgctctttagttcttagtttctaggccacccactctccagagccttcctgattcttgctgccatgaggcagaactcaccaccatcatgaattggctctccttatccccagacagaccctagctcttaatactattatcccattggttttgtttgtgttcagatctgtccagctcattgaaatgggggttcttggagggtagggaccaaaacttttccacttttgcatctgatctagggcttggcatatagccaaaattttaagtaaaggaatgaaaaaatacatgttttgaatatatcaaactcatgcaatgcacgcccaaataaactctgcaaagaaaaatgctaatgtggatagtctctgagaagtgtgagttgtccctgtctccatggcagtcacaggtttctaagggacagggccatctttgctttccaaaattttccattttaggtttgataacccatgttgtccctgccatgacgaccaagcattctgggttgctgaagctactgatgaggcaggcgtgggtggctgcatgcattcagggtggattccacatgctgttctaggcaacaggccccataagaggcatttgaacaaaaatctgccttgcatcttccaccagtgagagagtattccaatttactcttgagcaatgacagtacactaggggcgtggggtccaaagtctgtcacttagggtggtttactgtaagggattacgttcttgcggctgttgggagagtagcagtttggaataagtcgggcggagcaggtgtaataaaaaaggaaggaaggttagaaaatggataaatactatatttgggtcttgaactaattttccaggccaaatttaatttcactagcaccctctcttggaaaagttggcacctcttagatatttgaagtggattctaacctaagggggaacggtccctaaaaggaaacatggatcgtggttgagaggaggtcaatcagaggagaatggcgtgagcccagtggagccagcaggcccctgccatgtgtctggtactttcctctggcttctggccagatatgtggttctcccaagccatcaagatagtcaggtaagaatagcaccaggcagcgggaagtattctccatctgttagactgaaaaaactgcatggtttcttccctcatctaaaccaaatcaaataaaatattcaagcaacaataaaatatagcgtaactccgtccaactgcaacagaagctcatcctgtttttctggtcttgactgtatgatcagatgcattgacctctatgcactgaccttcatagcttgccactgctgagtagggcctttggagttcctagcagggcttagagcagactgcacaggtctggcaggcatggctgggtggagaagaaaccagacttcctaggaccggaagcagcaggcggcaagaaaaccagcccagcaggcacacggggacccagaaactacttttccttggaggtttttctattttagtacatgtatctatctccattttaaatgttcctcagtgaatgacctcctctggaaggtgtgaaagaatatccattagcaaccacaggagaatctttttcctgggaaaattcctcaagagtggtgtgactaccatcccagggaccagctggttgcccttgtgtggaacgtttctgcaggctttttgactgtaagggctgggaagccctgccatagtgtgagtgaggggaagctggagggcaattactggacacagggcagtggaatcgggggactggaatgtacagatgacactcaaccaatctttaaaagtcagcactagagcgagttattccatgatcagatggtgagaaggaagtgatttttatggaggggcacgctccctcctgctaggaagacgttagcaaccctgtcaaatgattccttaggagctcctggctttccagttattattttgcctgttaagtgttcctagcaagctcctcggggggaccgtgagaggaggctgcttccactccttcgctagctgtgaggaaagcccgcatgccatgctgtggccttctggagccctgtcccccagggtgcctcagagccagcgttccctgagagcacacagcctcagctgagagaagacagcaaaccctgtcccctagagaggcatttttgcaaaatgtgcttacttcataggagggaatgatattggtagaaaaacaaaacaaaacaaaacaaaaaacaaaacaaaacccaaaccttctttgtctctacgtaggagttacaaagatctgtcaatttcagcagagagagacttttcatccaccctgggcatgttcagctgagatggtgtaggagtttgtagcagaagagagagaactctagcattcactttctaggtttattccatcccgtacatttttgtattctgtaaatccaatgatcttaccaggaaatcttttcattcacttgaaaccaaacagataatcgaggggctggatctagtgttgtatgtacaatgcttctttagagcacaaaaggcaaattaaaactagactgagttttctgttcggtactatatgagaataattaaaattttaaaagacgacacaacagaattcagagccatcctgcaacagcggtctttaaatttatacccaattgctgataaaactcagccctggagttgtcttcctgttattctaacatctttttcacattcatcctaaaatcttaggaaaaaaaatccaaaatgcaaagagtttaaaaaactttcttttttttttctctcaaagcaaatagttccataaaacactaggtcaaagggcctcagtgtgtgtgtactgagtttgaagggccaagcaataatctataagagtgacctattagcaatatatttgcaaaactaaaccaaaatctgtacaggatattatcaaagccttaggaacaacagaacatacatattttatggagtggttggagaaccatctcccctttagtagttaacgtactgatgagtgtccccattttcataagcaaggacatactaacactaagcagttgaaaggcctgtctcagaagcatcctgccccaggtagctgatcacggtggccccataccacgacacagcttttcttttggttggtcttgctgagtgccttctctagatttgggctgtcattcaagcctcttcatttacaatgttcattaaaaattcagtaccatacctgtcccactcccaaccattttttacttcctgattcttttgtttgccttgtgggtaaaatgcaaatgtgtccaaggtgaaaaagcaaaccaatcaatcaacctttgagttttttttccagcgccaggaatgtgacatgaacaaaggtcactgaagcagcatgaggagtaagttagcagggccctttgttgtgtgtgtatgagtgtgtgcctttacctaagctctgtccccttacggaaatggccgtagaaggcctagtgtgctggttgcgagaggttttccaacgtgattcttaccccaaatcataacaggttcattctctgaggtttacccaccttcaaaacacacagacaagggccttagttcaagactaacactgaaaatgtcacggacattttcacgcattggacacacgacagcttccaggagcttgtgggtctattcgttatcagagatgctacacagacttcttaacagcttgtgttagggaactgttcttctttcctatccccggaagtgttgcacccatacacacaaacccacatctaagagtgtctcctccacaggctgaaaagaacgcctcttggaatgtcaagcatgaatataaaagggtttcccgtgacagtgatcactgaatcatggggaaggaagctaaaaggcaaatttgcaattcatcacattatcccctgttgtctcaaatgtgattcttttaaaggcaggctgcatatacattctctttttgaagcatttttttttcttcttgtaacacattgtatattcttgtttttgtagaatattcgaatgaggataaaatgatgaaaattacaataggttaattgcatcccttgtatcacatatttttggtgcattaaaaaaggagaaaaaaagtaaaagcaaccagcataataaatccggcctagagaactgtgttagtgacttgaagggttaacacagattttagaagtagttaaaaatagtattagaggattatacatacaacagtttaaaattcatatggattgtatttttttcttttaaaaatggcaaaatgtttttggcaaatgtaagcaaatgacttggactgcgttgggtctcaccagctctgagccgggtcagtcatagccaggcgaggcctactgcttcctgaggtcactctgtggggctgggggaaggtggatgcccgccactgggaggtgctggccccccacctggctccccctcaggccctcagtcttgaacatggaaatggagctggtgagaggtgccaattacaaactccagcacggatcacccattagcatcactgagagaactctggggccttgaaccacatgcagactgggtgagtcgtctacacagtgacccatattgcgaaagtcagagagaggagtggtgcttccacccctccgacttgtgcgcccgcccccacccccacctggaggaagagggtggcacggggtgtgtcactagtgcttaatctggcaatgttttcaacttgtgggttttttttttttattttttttattttaggaaacttcttttaaaaaatgttttctgttttgtatgtgtatgtgtatccagaaatgtccatcctccaagctggccaccactgttccctgaatttggcagtgcctgttgcttgcagctgtcagcatcctgaaaaccatgaggtgccttcaaagtagactctgtggcccagccgcgcgagtggcctccaggaccctgccgcacgatgtcattctctccttattctgaatcctgtctggctctgatgctgagaaaaaggacaaagtcggtgtgtctgtctgcgtgtgtgtgcatctgtgcctgtgtgtgtgtactgagttttggttttttttggaacctttttttctttttttaagaaaaaaatgacccttggattactaatacagagttcagccctcctttagtcactataaaacggactccatgttttcacaccactcatggtcttccaggttatagataaactttgtcctatgtgtctggtttgcgggcacagggtccctccccaggttgtctagggtcagagtagaggcaaagaactcactggtgctcagcccgccctcgtggtttttgatgtagcgtttatagtttttcctcaggcactgccacgtggtggtgtacaggatgaaggcgaaggatttgagcgcgatggcgatgctgacatacaggtatcggtagaccacattgtcgtagaggacgcaggcgccttgctccccacagaacgtgctccagaacaggcaggtggagtcgatgccagccccgaagatgaggggtggagggatgaagcctgttaccgggaaaagaatgttaaggttctggatctggtggccagtgctcccctgttcctgtctctgcctagcttttcttatagcactgctaggcaaatatgtctgactccgtggctcaaagacatgctcaggaggcaaagcgcatgagtttgtgtcccagttctgcctttttattatggtacaaatctgagcaagttatttaagccctcctgccttagtttcctcatctgcaaaatggggatgatgataatactacagtcttcaccagatggctgtgaagactaactttacacatagaaagcatcagtctggcatggtggctcacacctgtaattccagcactttgggaggctgaagcaggtggatcacctgagatcaggagtttgagaccagcctggccaacatggtgaaaccccgtctctactaaagagacaacctggaatttgcactgtggtacatgttggtgcacatctgcagtcccagctacttgggagactgaggcagaagaattgcttgaacccaggaggcagaggtagcagtgagccaagatcgtgccactgcacttcagcctgggcaacaaagcaagactccatctcaaaaaaaaaaaaaaaaaaaaaaaagcatctagaacagtgtgtactgtgtcactttaccatgtaaagtgaatgacagctgctattatcatcatcatcctctgctgagagcctgagaaggccaagacggtcttccttgaagagaaacattcttagttagtgtcagtgaaagcagcgtagtctcatagaggaaactgcacagcgccggcatactgtgtgtggtgttccatagaggaaactgcaaagcgccggcatactgtgtgtggtgttccacagaggaaactgcaaagcgccggcatactgtgtgtggtgttccacagaggaaactgcaaagcgccggcatactgtgtgtggtgttccacagaggaaactgcaaagcgccggcatactgtgtgtggtgttctacagaggaaactgcaaagcgccggcatactgtgtgtggtgttcttctgtttgaggcttttagggctgttgtgctcttgagtgcaggcaccacaaattggacttgagtacatctgtgtgtatacacatatagtttaaatggaaaatatctgcatatatactgacaacttcgcttcccctggatatttaatattcccagctcagaatgagttggtaaccagttttgaaaccctcacggtagagcatttccggtacctacaaccagtcaccaaaaatggcagatgagatgaaaaccgttccccttccttacttccgttccctgttcctctctgtgtttctttgcctgctgttatccgagttatcagacctggctgcccatgacaatcatcatccagggtgtcccatcccagaccactgaaatcagagcatttggtgtgcagcacagtcctcagcaccttcacattcccaggtgattctgagtgaagggggagagtgtcatctgtactatgggaaagtgacagatgagtcactaatgcaaattaactgttcaaaaaaactgtccccttgaggccagaataaagtgccaaccatcttcagtgacagactgcaggaggaggaagtgatctctggaactaggtgtggccaactctgagatcccagggcctctatacctctgtctggagtgttccttgcagagctagtcctagagcatctgaatttcattttgtattaaggaaggtccctctgagattttgatgagatctagacccatagcccagcaaaatgcacctacccataaaatcaaacctgtatctcagggggttcataggcccctgaagtccatccatgattgctggaataacagcatgtgcattataagcacagcagcacctccattctgtggggcctccaaaggcagttggggagagagggaaggcttaatgaaggaagcagcccttcccccggttttaatgacatgcctggaatcgggtgagagcggggctttgctaccctatgagtgctaatgagcttggcagagctccaggctctcggcccaggtgcctctgtacttctccttggaactcttcacctccgctgcttgataccccaaagagaagccccggagaagatttctggttgaaatctcattaaacttcccaagcagctcgatttaataaataagctccaagctcaaaatcccacacaacctgtttccttctttccagctgccaggttgggctgtggtcctgccgaatggaagcgcatattcgtagcattccctgtgatcccaaaggctgcccaggtgtctcagcccttccccaccaaccctgtgtgttttccctgccccctaacaagtgccttttttcatttcactccagttgaaagagccaactggaggaactgccatggcaaccgcataatagaaactaagccacacaccacgttatttatgtaaaaaatgaagatctggagccagtgtgtattacagatggacctagagataaatggaactaatgtggcctgtttctgtggcacagcagggcaaagcaaatccattcacctttctatctctgcacggggcataatcattatattgtgattagctcccaaatgctcctccctccttgtgacctttcttgaggtcatttcactttgttctagccacccaacacctggtgacggggagccaaggttagagaggacacctctagtaaatgctttgctgctggaaggaactgagggtacaggtgtcccttgctctataatgcatggatacttgcatacaaattccaggtcggtgcaaaccaggtcatattttaagcacatcagaggaaatttgcaacataaaggaaccaaattcgttaataattgttaaaaccaaaatatccccccaaaataccactgtgcaactcattcatgtacctgagtgagaattcttataatacttggttgtcttctaagtagggcatactgctatgtgataaatatgccaattatatcttgcctattgtcaagctccactaccagatgacaaaacctctaaacaacaatttgaaagctaagtactcaggaggccgatgggaggatcacttgaccccaggagttccaggctgcagtgagccatgatcacgccactgcattccaggctaggagacagaatgggatcctatctccaaaaaaaaaaaaaaaaacctaccaaagtttttcatgctatgctctgttcaatatttcagagtgcatttgtggtagagatgaaataaattttttttttttttgagacagagtttcgttctgtggccaggctggagtgcagtggcatgatctcggctcactacaacctccgcctcctgggctcaagtgattttcctgcctcagtctcccaagtagctgggactacaggtgcctgccaccacgcccggctaatttttgtatttttagtagagacggggtttcactatgttggccaggatggtctcgatctcttgaccttgtgatctgcctgcctcagcctcccaaagtgctgggattacaggcgtgagccaccgcacccagctgagatgaaagaacttttaaggtgccaaaagtcctggagaaagtcacttgatctttcaatgtctgtttcttcatctttaaaatggagttaataccaccctgcctggtaagggctaaggtaaacactacacaaatgaggtgtgtgtgtgagtgtttcgccaagggtctgatcttgccatgcaaccagaacttttgccaccttattcatgttagataggggatttggggtggtattttagaataaactctaggttgagtaccttaagtataacctttgtgagattccttttatacttctgaatagtgaaaatattggctttcttttccatcaaattcatcttttcctttttattcacttaaaattctttcccaaaggggaggtctagctatcaggccctaaactgcaggtgtgcggagaataccagagacgaacggactgcatcttttttgttagaggcctctgccattctggaactcacctgatgagtcacagaagggagttccaccttggtgactcattttcacgcccagccccacatccttatatgttcgtcactcagttggaccaaacaaaaactcaggcagtccctgcaaggagctggttccccatagacaaatgggagactgtgacagtgtgactggcaactgtcatgctaagtagtatcattaactaccccctacccaggactgtatagagtgctccacatccattatgcgtcccctccataaccactccccctgccccaccttatttcacatacaaataaactgagagtgagattatttgttccaggtttgatatttcaaaattccaaacccaataatctccttccttctaattcagactttgttgatttgagaagactttagagctcttattggggatttccagggatacagagaacattttatttacccttttgctaagctcctggcgtaactggcttgaagaagcctggttttgaagtgtgcagagggtgaaacacacagggggtttgatctttgcaaagcgggcagcccttccttctctggggttgctaatacatagagaaggctgggagacttattttgtaaacaaactcagtatttcgctggacacctgaggcagtaatagcagatactatgtttgtcagcaggaagagacgcggagttgtcatcgtggtaggctttgatgtgaactcagacagggagttcacatctggagttttggtgactgggaggaaatgcaaatttatgaaccagagacagctgatcttggattctaattccgccacttgggaactgtgtgattcacacaacttgagtgaatctcagtttcactgtttatacaatgggcacgatcataccttcaggcagagcttttgtaaagaatcaatgggatgccatttgagaaagccctcacagggtgggcgctccaaaaatctggttcccttgctgctgtttggcttttgttccgtgttcaggaactcttttgggtaaatgaaaatccgtcctaagttcaccacctctagagaaagagttgtagaaaacctttcaagctgtgattcagtgaataataacccccactggcaagaattctgtacatgtacccgggaggctgaggcaggagaatcgcttgaacctgggaagcagagattgcagtgagccaagatcacactattgcactccatcctgcgtgacagactgagactggtctcaaaaaaaaaaaaaaaaatttctccacatcatcataagttttagaggataatcaggtgtgtccagaagggaggacaagggggggggccaggtgtactttagtgtcctctctggttttgagcaccttcactctgttaagtccttagttacaaggaagcttgatgatggtggtgtatttctttagtaactgtgtcttttgaagaaatgctgtcttccccaaagcctgcaagagcagttctctctcttttttttatcttgtcttctccctaggtcctctgggcaggaacttgtggatgaagcaggtgttaatagggttccatcactggggcactgggaacccaccctgtgctgaggaaggtatgtgcaggctcaatgctgttgcccgctattagagggaatattaaaaggactaaatcttactattacactctggcttaaattgcagctatatatatttcaatgcataaattgctgcacagtttaagaacactgtctctgttttcctgaaatctattaacagagattaaacctcagggccttatatattggctatttaatttactctcttagttgaaatggctgggcctatttatattccttggtctaaacttaaaaggtgaactgaaaggcttttgtaagaaaaataagttcaaattcctttacgggacaaaatggaagctgaaaattacggccacttacatttaaaaagatatctgtttctctctggcttacctgccaagacttgaattcaccatggaatctctattcaacctggtggaattactgttatgtccagcaccagctagaaagggagatgctgaaaagtgtattctcctggaaggtttaatgagttctctgcttcagcaatgccaagaaagaatctgggctgttttccagtgatacctgacatttacttttcttaaactggagagtctgcaggagctactatgttctcctttcattcctggaccccttgttaaagttggtaaggcccagagagcttaaataatctgccacatggtcaggaaaggcagagctaggctcaagagcaggtgtgactgactttagagggcccatggtaaatactggatgtcatctcagtacaggtaagggtggcagatcatgggtggtgcaggtacatcaggaggtgaggtccactgctgacagagccagggcacatggctggcgcctaacatatgttcgccgaatgaacaattaaaagtgtaggcaagtggaaggggtcttccatgcatcccaccgccgtatctcactccctctcatctctcacctggggcccctgggcatgctgtgcttgcttcttccaaagcagcacttaacacgttcatttttccacttgcctataaactttggcatatgcaagacgatgctcacagcaggaactcaacaaatgtctgacaagccacagcaggagtgtctaggatgtacttttccagagtagttcacaaatcaccccagaccaaggacaatctgctcaggaatgacccctgcctacagaaatgcaccccgagggccttccctatgcttttggctaggcgggcaggctggaaaattaagaggcagggtcagtgtatgtggggagtttgtagtggtattgtggaagctaagctcatccctaatgacaccctgagacacttgatctattgtttcttattctattaaaggcttctccatagcctcagtcccaggggctccaaacctcagcctcatcttgagctttcattgcttctcttttgctttcacttaggtcggttgggttgggggggtctcaatagatgctgtctcttatgtggctcccatctgtctttaccgttcaaacccactgctttgctggtggtcagcttctcacttcaatgcttttgatgggttatcctgcatcctgctaaacctcatgccctgctcacctgctgctctacctaaagcagaattctgaatgtacattcactctcccatctgaaacccccatttgctccacactggcaactactcagccaagtataatttctccctttgaaaatcaaggccctctgtaactcttccaaccccacaccttccccacacttgctttgttctcctactggagccgccagaggcaggatattggcacctacttatctgtgcaccctgagcagcccctagacagcaccttggatgtggaagagtctcagcacatgtatgtttccaataatttaatttggtgtaacgccctggcaagcagtggccccaggaacaagattctagaccaactcaggagcagagagtttgcccacagcctggagagaaaaggagtagccaagacacctgcagaagaataaaggaggatggactcaattataccaggaattctgctatgagtagatcgttcagtttactctgaattcactgacccttctccagctcagtgtcttcctcccctactcaacaacataaacttgtccatgtgagcctttcattaactcactctcaacatccacgctcttgacccctgtccctctctggccagcaacaccctgggctttgtcattggtcagaactgctccacttccataatctcgaagtcagacaatgaggctttggccacatcctccagttctttttccattatttattacaactagtttttacagttcctgtatctttgtcctctctcctttctcccatctcagccctactttgatcatcaccctcagcttctttggctccactctcctgccacactcctgcttctactccagggtgctggggccactcccagagccccactgaccagtacacctctgcagccctgccctggccctttctaccaactccttgctcttggtgggtaaagcaacaagggagaccgatctcacattcatttctagctcctgccctcttcacttacacccaagtgtctggaaagagggtcttcctgttcccctatcccatttcctcactctgacccatgagggtggtgcatcaaagatggccccctcattgtccagtatggcagacactggccacatccacctacttatgtgaaaactaataaaattaaagtaggctacagaagccacatttcaagtgtgcaacagcacctgtggtacagacagagaacatttccatcatcacagaacgttccactggagagcgctggtctacaccactcccaacttgctctacatcctttcttcctgtctcataaataattcccctgttcaccacattacccaagactttcttaggagtgggcactgtgggtgcccctttctaagactccagttcttatgcttccacttggagaataatgcataatgcagattcctccttttatttctcaaccctacccctctccccatcctgcgagcaccatctcggcacgagcctctgtcattcacttcattacagcagcaacttcttcagccatgttcttattctccacatggcagacaagccctttctaaaatacacagtggatcttgtcactctctggttaaagcccatcaacaactttcatttgcttcccaggttcaagggattcttctgcctcaccctcccaagataaaggtcaaatgcagcaacagggcagaagcccttcctgaccaagttcctgatccactaccctctccagctccatcttcttctgtcccccctttccccccagtctgggccttctgcagcccccaaacatgctgggacctttgttcatccccgggcttttaccccgtaagtccttctccctgctcatctgtatgactcttactccttccccagggctgagcatagacatcacatcctttccaaacccactgctcccatcccaaggcaagattaggaggcccttctacatattcctgttgcacctgtgccaactcgaatcttgtcacactaacctgtgatgtccccattgtatccccattgcccttgctaggccagcaaaaaagttgatgatgtcacaggatctgatgtctttgccggccttcacattaacaataatggtggttaatcttactgggtcctgcaagaaagggaattaggccaaatgctaagacttcttcaatgagctgctttcaactgaaagatgaagctgtgtcatagtcttctagagcagggttttccagcctctaattggagactcataaggggcaataaaatcaatagggtgggtcacaaccaacttttttaaaagcatgtaatagactagaatagaaaatgtcagaatgtgtcatacctattacagtgagtattttttcatgattttttttttttgtttgtttcagctgtatctaggcataggcatgtgcgtactgggccataatgcaaaacttgtcatctcttgctctagattacagttgcagaagttgaaaaacactattctaggtaatacctggttgattattcctggggcagacatacagatattgaaactgctttacagcagtgtatgatgattttaacagtatcatatgcctcataatgttcacttttgctttcaactatcctacaattttcattaacttttcagaaataccttgcaaattgtttttcatcttgtgctatcaaaaaaatgttctgccagttgcattgagtccttagtatctgtctagaggtgcagagatctccatagcaactccacagatgaggagggtgggctcttaccttccctggccagccccagaggactcgtaatggcagagctgaggtcacttacctggggatggttcatggcttagaacacaataggttttcaataaacattagcttcttgaacaaatgcatatgtggaatggctttaccatttgcaaaaattagggtgtcaatgtgccagttaatattacacatccacctatcgatccaccccacactgcagtgagagcaggggtaaaatatatgcagactgcaccctcccactgataggaaaaaatcagcacgatcataactctgccttggtatttctgcatgctactacagcttcccaggaaggcccaaatgctttactttgaattagcgctgaacttgttttaattggggcatcttcacacctagagcacttctcttttccatgacttagacttaggacaatgccatttgagttcccatgtatataccaaggaacatggattgatagtggttgagagcattctgaggtcttctaccaggcacagagggaatgatcacagattgatagaaagtttttgctatagacggagaaggaaggtgaggagagacatatgctatgtatttgccattccccagggaggaccttaatggatctaaaggttaatatttttctttcatatatcggtatataaaaactaatctcataaaagtaacagacatttcattcaaaactttaaaacaaatttagaaaatataaccttattactcaaagataatagctgatactcttctgataaaatggaaaaatattgcaaaagttattacattacagacctgtttttccccttcccccatcacatgccctttctaagtctatatttttctttccagaattttaaaggggaacataaatcctactgcgattatagaccataactgatttaactaattgtctgctgttgggcttttgggttgctgccaattttccacttttacaaacatttctatagctaggtatttgtgcttatccacgattatatacttggaatgaggaattttatttctactctaaaaatacaggtcatggttgttttcctttctacattcagatgccacttaaagtccactggggaaggtgactgtcctattattcaaggaaaaaagttatcttgatcttggccttaacaaaagaatgctcataaagcaacggtgtggtatggcaagagaaaggtaggcatagctgggaaccaggcccagcgtcagcccagccagtgcccaggaaggaccttgggtggtgaaccatggactatctcatcttccttttgcctatcttaaaaacaagagggtcagactttcttccttctttccataccaaatctggaaacgtgggccctatagcatgaaggtcacatttgccccatcccagaaattcaaggtaaacaaactaagtcagtttggaaaaatttaaaggatgcaaagtttccattttcaaggcattgtgagaacgcctctctctcccagctggcggccccataaatgaagcatttcacaagctgctcatggcttgcttaatgaagatgccaaattacaccaccagatttttttcccctttggtgccatctcttttcctccttatgccgatgagaattcacggtggcgtgaagataagagttggtataaatgagaacttcgtgatatcgaggcagtgtctgagtttatctctgaccaaaattttgagacttaaaatttcttatttactaataattaaactgcaaagaaaaaagagacagacctaggaaatgggataatttgactgacagttactcacctagtaataagcatccaattcattattgaggaaataaagagataatacatacccaacaaacgaaggaggagaaaaagaactcccaaagcgtaagacttgagttcagggctgactgtcctacgtgcaaagagatgaagagaaaaaaaaaaccagatttttatcattcccctgtaattaacagaccccagagtcatttgctgctgtccatcagagctcttctttagaaaattactaatagtgtcttttttaaaattactaatagtgtctttttttttttctgcctaaagtctgaaaaataactgcaactgtggtgccaagataagtttaggaatttaacagtgttttttaataactggagctaaccttgtcattcgaaggacagaatgcaaatttggtcataaaacctgcgtttaaagacatgttggttttgctgagatcaggaagcatcttaagtgggtggggtacacgtatgggggggaaaacatcaaccgagaaaataattccccttatccttcacaaacaagctgaaaccatgagcacctttaccattctccagtcattttgtgaaatccaccagattagcatggttagacaccctggatggaccatttgggaaataatccacttagcatgttccagcactgtgatggttaatattgagtggcaacttgattgaaggatgcaaagtattgatcctgggtgtgtctgtgagggtgttgccacaggagattaacatttgagtgagtcagtggggtgggaaaggcagacccagcctcaatctgggtgggcaccatctaattagctgccagcacagctagaatataaagcaggcagaaaaacatgaaaagaccagatgggcctagccttccaccctacatctttctcccttgctggaccccttctgccctcgaacattggactcctagttcttcagtttgggacccagacagtacaggtaagtcatcccagggcagcaggtcatgactttcattgagcgatggggacgtgactctggctggttgagttagacaccagtacaacatccatgatgagtccagtgcctctggacagaaacacagtcagcaccctttagaacgtgcacgttacaaaatccaagttcttcaaagctattatcagctccatgtctccggtttttgcactttcatttgaaagcactgacttgaaagacagacacataaatagagacaaattctccttatcaagaaagcacactggtataatgagttagaatatttatcacctgaaatttgatttcctttcagctatcatatgtcactaggaacaaagtgagcaaggtgctaagatctcccttcatatcctgttgggaaactgcttcctatgagaagaagaatccttcttggcttgagtcatgaagaaacggggagggctccgtgtgaacactattgaaagctctggacaacgctgggagggagtcttagttctaaaggtactagctgggtgaccttgagaacactgcctaatttctctcggagcccagcgtggggcctaagaggggctgggcatcagctttcaacctcgcttccagatgttctgagcactgttgttgggatggtcctgtttggcatgacagtgggtccattcttctgggaggggcaagggctggtgcacatctgtgcccctgtgccagcctgagacatctgtgatggcaaatcagactaggaaggtgatggaataaaactgtgtcttggacctctcaatatgcacaatgcatagcatgcgcttccagcacagcgtggagttacaagcctaggtcatttaggccatctgtggctgattaatttagagggaatcaaatatttccagcaaagctccaagagctgtttatcaagctgagatctggaagtgattaagaatttcaacaaactttccatgtttggtagtcaccactagtcagcgtctagaggctgggtttttgcagaggagtcgtggggcaagctaataagagactagtcatttttcatgcttctccaatgcctttagtgtatgaatatcacaatataacttcacgagaacgtctaataatgaaaaataaactactcataaggcagccacctaaaacctatacatgagatctgatgggttttgtccaaatgcatattataatcatcttctctaaatagttttaaattcaatagttcatttcataaacactttcacattcttaagaattttcattattccatggagctgcagtgccataatttaactcactattccaattcaggtttttctgctattatagttaacgttgtaataaaaatttgtctgcattgagctctttctttttttcttcttgtaaaggagtacttttttaagataaatggcaaggggtagggttactgaataaaagggtctgaatatttgtatggctcttgacgcacactgtcatattgcttttttgaaaggagtgatagccttttcccatgccaccagcaatttgtgattttgtcagttttgccacagccttgcaagcactgggtgtcaatttttaaaatttatttttcaaacttagtaagtataaaatggtaatttgctattataccctaatgctctgcacattcgcaaggccttgctaatgacgttctaggtaacattagtacttgtaaaaatcctcttccttgggaattcataataaagatgaggaaatgtggttggcaaagtgagagagaagctggataaagtagaggtgaggtgcatggacactgggtacttccatgcgtttcattcctacttttatttccagcctttgctattgaatctgttcacttggataactgcatcccaattaggcaagtctgtcttttctcccctctgagacagagtcttgctctgtcagtcacccaggctggagtgcggtggtatgacctcagctcactgcaacttccgcctcctgggtctaagcaattctcctgcctcagcctcccaagtggctgggattacaggcatgtgccaacacgccctgctactttttgtagagaagaggtttctccatgttggctaggctggtctcaaacccctgggctcaagcgatcctcccgccttggcctcccaaagtgctgggattacaggcatgagccaccatgcccagctgatgagtctttgtgtagagtaccttcccctgattcagatgaatggcagcctatgtgttagttcacttctgggtttccaacacaaatctaggtaactctgcaaatgataaaagttactcagaatattactaatggctcatctttctttggggcacttcacctatccccaggacaggtccccagagacaggtaacaatagaatttcggttggctctctccagcaacctctttgtacaagaatggtcactgctcacctgccgtgagccctgctgcacaataacccgtcaagtctctatgtgtttgcacacacatggtctcagtgggtcctgctccactgcaggaggcaggcaggatgggtcatatcacccccagttacagattcaggagcaagtctagggggaaaatgcccacggtcatatggctaagcagtggcagggtggtgggggctgggcactgacgccactttcattttcctccaacgaggctgcgtcctgtaaggctcaatgcaggatccttttcaaaactgcctgcaggctctatttctgggagaacatgaaagtgctgtcttctcccccatgccctgccttcttctcttggtgggaggtccctatcaaacacaattgattcctatcagcctagagaagctgcgctccttgctgtggccctagctcacctggttcgagagattcctgttgtctgaagctctggtccctaggaggcctgcagatgaacaccaggtggaaaggaggagaggcggggctgtgccgagggcttacctgatgaggatgatgactgagggtgtctgtgccatggcaccgatcaggctgcagatacacatcacacagaggaaagtgaggaaggcctcttggcacccaggactggggcattttccaggaaccacggttgcgttctcagcagggacggtggtgaggcacgcacagcccgtgagattctgaaagggaagcgttcagcccttttatctgggggtacttccggtttccaaaggcaaagccatccatcagctgaatctgtcacagcctaattacacattctgtggcattccattaattaggcctgaataaacgagttagttagcttttttaaggaggctgcaaaacacacataaataaaggaatatttacggggaggagagctgatttctctgtctcttgtgtgtttcatttccattctcaagaatccctcagtaagctgaaccacagataaatgtgtcccccccaatacaattagagaggaaattgcgcttccacaatatgataaaacgttgccaaattaacattgtaattacttgccaatttgtcctctcttttatgcagttataattacactgaagtgtattaaaagaagtaaatcaggtaacccgcatattgttgctggtggagtgcccaacacggcacttggaacaaaggctgcacgctgtcacgcgtgaagtcaccgcgtctgcaaggctggccgagggacagctgatggaaagttctctggaggctgaggaagcaaagggggctaagagatgcaggagcttggagcagctcgtggggagcagagctaaaacccaacaagatagatacatttattaatatatgatcagagagaagaaagaaaagtgactgcatttcatttgatcttcggggtggattctagcccagctgcctgttgcagacagggtcctctcccccactcactccaggaatttctgatggcaaagggaggagcaggggctgggagaggcagtgcccggtgccaagccaattaaggttccataataatagtgcagaggcctttaatgaatacaaagtgaaaacaatcataaatgattcattgcttttccttccaggactgcttggctttcagagcacatgcccaggtaaatcctcctgagggtcaaataaatcccctctggcttttacagttctcctcccctggtcctccccctctccccacagaacacagagatatgggttttctgatcccactaagctatatgggatggtttcaggggtgtctgaaagtgttcatgtgccccaaacccaacagggccagtctgtatcgctgtgcccccaacaggggcttttattcatgggggaaggaatgggggcagacgtacgctggggctccacccttcccctcagtgtctgcccagagcaggtgcctttgtgaaaatggttcaattagggtacccaggggcatttactgtaattcccagaagatcccgaggccccgcccctctgttccttctcatgtacctctgcctagagactttttagctctttgtcaaaacccagctcagatactgcctcccttctcagaacctcacctcactgggcacatcccagcctccttccaagtcctgcagggcccttttcaagggtcgctccaccctacagcagagacctttacatgcctcctggaggagacaagaacctcgggacaagacctatgtcttttgcattctttccctagcatcttttcctagcgcagagctgagacgtagatgagaaactaagcatacagctttagaatacacatgagaacgaaccttcctcacttttattaggaagcaagacttctccccaactttcacttaaaatgccactcctcctcttcccaggagaggaaactgcccactcctccccagcatcacagccaaacttttctagctatttagctcaccacctgcatttccttttctcccacgctctcagctgactctgactggcttctgtttccacacgcatgaatccggtggggctaagctcttcagtgggctccatatcccaggcccaccatgcatttttctctccccggagctcccaggagcacaggccccttgctcactactcatcactcccttgtttggcttcaaagctccactctacctgtttccctggtcctcctctggtcactcgctttccatctttgttgctggtaccttctcctctttcccacctgctctggactttcttcatctgtactcttgccccagctctccttccttcattttaccatctctgcatttgatcacaactctcccaaatttaatcatctttagcccagatccttcccaagactcatgagcacgggtgaggcatcaaaactgcctccaggaacgagtgcctgtgctggcttctgtgctttcagcttggcactactgtcccgcctaaggctggaaagtatctcccccgaattcgctttcctgcaaggacgggagctggacaagaaggaaacctgggagagactcagaaggcaggagttgtgggacaccagcatatgccaccttgcggtatgccccttttgcataaagaatattttgagctgattattttgagaaaccacagacacaggcagaacctctgacaacagaagttactgttgcgtaaggaaaattacatttacaaaggaaatctccatttgtaagggtggttcctctctgtaccagagataaaggaatgactgaatccctagagactatcatcaatctagaagacactgacttaagcttgcataacaaatgttactcttttttaaggtgctttatctgggcatctcctcataactggccttccccacacccttctttctctgtttccctggaccgtggtattcaagcctgaagtcaaagccacgtctctgagatgctctcatttctctggctatctcctgtgtatacatcatgtatatgtgtttctaaacctttgttttcctcctgttaatctgtcttaggttacaggggtctgtcccaactgggaactgtgaagcgtaaagagaaaattatgtattcctcttctacaaagggaagctgaggccatttctcccagaaggtcacacggtcaggcataaggacggacacacagacgcgcccggaaggcgccgacctgtcccagcactcccgacttggcgccgccttcttttctgcctaccctgctgaccagtggaggcgccatgcccacctctggtgacctggctgctgcaggccacgtggctccccacatcgcagagtgcccatcagatctcctgagcagccatgccgcacagcttcctgggatgttcccctgagctctgactcacccacctgtgccaggggcgtctagtgaggaaatgctgctttgcttcttcctcttacttcaaaacactgttttcctgacagttacgcagccccagccccagctccagctccaaactcctttccctccacctcttgccttagtaacggcaccctattgactataaaagtaatgacaaaaaccacaattttgcaccaacttaacagaaaccaggaggtaattctgaatcccccgctcacatacctacatcaaatccatcttccccctgacactaaagctaatgaagacagagaccactgtggccgtattccctaatttacccagccatccaggacagggcttggctcacaagtgggattttatatacatatataatatatatatatatgttgactgagtgaacacctaagttctgttcattttgccatgtcctaaatctgtctcaaaccctgccctagttcaaactacttgcaaccatccatctttgattactgcagtggtctgtgaggaaaaagatttgggactgaagttcttagaaccatatggactcaaagagtagttaggcgtaaatgaaaaatgggccccttgtgggtggctgtggtcttgtttggctaagtaccccaggaagccctcaattccagtacccccatatcacattcctgagtgttcctgagaggctacatacttgtagcacgcagtctctcaggaatgtgatatgggcactggagttgagtgactgacgccagaaccctctgaatgagccatgtgatcggtgagctttctttggtttaacaagtcatctgcaattgctgcctgtgtcttggtcttatttttgcccatacctaggctatggctcgattatattatatttaccataaaagaggaaactggcctctctctgccctaaaaagtgttaaatccctcctgaaatggatcctctgatcatggcactcatggaatgggataaaatgagacatctttatctcaggctacagctggcacggtgcctgcacagccccatccgggtgagctaaatgtgtccatgtctatgttcatgttaatgaggcgagcagacagcagggttaagctgccacaggatttgcagccgaaacaaagggtagcagtgcgtggtttgaatgtttggtgtcccttgacccaagaatccatatgttgaaaaataatcaccaatgtgatgctattacaaggtggggggtcttcaggaggtgattaggtcacgagggtagaggactcatgaatgggattagtgtccttacagaagaggccccagagaactgccttgcccctcccaccacatgaagacacagctagagggtgccatctatgaaaaggaagcaggccttcatcagatgtcagatccatcagcagtttaatattggacttcccagcctccagagctgcgataaatgtgttgtttataagccatgcactttaaagtgttttgatatagcagccaaaatgggccaaggtagccccatgctgaatagacaggaatgggatgatttagggttaatgacagaagaagaaaagccagagaccggcacaagaccaatgaaaatgtctgtttgttggtgtccaagaggaaaaggtggaaatggatggatctctcctaaaggttctaggcaaatctgtatttatttattcagatttaatttattcatagctgtgagagaggctgggtaggagatgccagagtgatctgtgcaaggacttggatgggtttccttttccatccaatgagtcaatccaccaggatgggctgggtggtcccacacatggggagcaggctggggcagccctgcaacctctccagcaggggatccaagggaaaatgctgcagttgtggtcagatggcaaggggtaggaagctcctttattgggcttgtgtgacataagagcccagatttgtccaacgttgtgctaagggagatgggtgcataaggtcgtgaggctgttaaggagggatcttccactcagatgtccgagtgtggtaggaagaactgcagatgaggacttaggtagtttcacctttcccagagtgcagagagatgatttccaaaaatggggttttcaactttgatgtgaagggaaaaggggaagtaggggataccccttcagctggcagtaactgggcacctacatgggaagccctagatctgcaaatgctttgagctataaaaagtttgaaaagctggatgtgagacagcagtctcatttaaggggatgataaaggctgggatcctaattctcaccccaaaccccaatagcatagttctatttggccaatccaaaaagcaggtgtatcttggaactgacctgtagactcccatggtctgaatgaagtgatatgtcccctaatgctttctctggctgtccctaagacaattaactagtaagaaagcataccagatttcagattagtttatgattgcagaattggcaaatgaccccattttcaatccctatttcaaaggcaaagcagtgtcttcctggtttgccattctctgggaagaaatgcagtccctgctgcctctgcgagaggtgaattctctgcttggcatccaaacttggggggtggcgggatctagctttactgtcaataaaatgtaccatgacacttcatattaataataaggtggccactgagctcccagaacagacctgacaagtttgttgacccggaggacagggggaacaggcttgtccgttctacgagaacatatccaacagacagacctgcccaggcataaaaggacatatatacaatatgagtcacaatgtggttggtcagagctcaagttttgcagcagtctggatgctcattgataagagactggttaaagacagactacttgcacataggctcaaaataaaaggatggaggaagatctaccaagcaaatggaaaacaaaaaaaggcagaggttgcaatcttagtctctgataaaacagactttaaaccaacaatgatcaaaagagacaaagaaggccattacataatggtaaagggatcaattcaacaagaagagctaactatcctaaatatatatgcacccaatacaggagcccccagattcataaagcaagtcctgagtgacctacaaagagaattagactcccacacattaataatgggagacttgtaacaccccactgtcaacattagactgatcaacgagacagaaagtcaacaaggatacccaggaattgaactcagctctgcaccaagcggacctaatagacatctacagaactctccaccccaaatcaacagaatatacgtttttttcagcaccacaccacacctattccaaaattgaccacatacttggaagtaaagctctcctcagcaaatgtaaaagaacagagattataacaaactatctctcagaccacagtgcaatcaaactagaactcaggattaagaatctcactcaaaaccgctcaactacatggaaactgaacaacctgctcctgaatgactactggatacataacgaaatgaaggcagaaataaagatgttctttgaaaccaacgagaacaaagacacaacatacctgaatctctgggacgcattcaaagcagtgtgtagagggaaatttataacactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaaacccttcaaaaaattaatgaatccaggagctggttttttgaaaggatcaacaaaattgatagaccgctagcaagactaataaagaaaaaaagagagaagaatcaaatagacacaataaaaaatgataaaggggatatcaccaccgatcccccagaaatacaaactaccatcagagaatactacaaacacctctatgcaaataaactagaaaatctagaagaaatggataaattcctcgacacatacactctcctgagactaaaccaggaagaagttgaatctcggaatagaccaataacaggagctgaaattgtggcaataatcagtagtttaccaaccaaaaagagtccagaaccagatggattcacagccgaattctaccagaggtacaaggaggaactggtaccattccttctgaaactattccaatcaatagaaaaagagggaatcctccctaactcattttatgaggccagcatcattctgacaccaaagctgggcagagacacaaccaaaaaagaaaattttagaccaatatccttgatgaacattgatgccaaaatcctcaataaaatactggcaaaacgaatccagcagcacatcaaaaagcttatccaccatgatcaagtgggcctcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaatcaggtattgatgggacatatttcaaaataataagagctatctatgacagacccacagccaatatcatactgaatgggcaaaaactggaagcatgccctttgaaaattggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcagatggaaccaaaaaagagcccacatcgccaaggcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccacatatctacaactatctgatctttgacaaacctgagaaaaacaagcaatggggaaaggattccctatttaataaatggtgctgggaaaactggctagccatatgtagaaagctgaaactggatcccttccttacaccttacacaaaaatcaattcaagatggattaaagacttaaacgttagacctaacaccataaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaaaaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtgaggaaacaacaggtgctggagaggatgtggagaaataggaacacttttacactgttggtgggactgtgaactagttcaaccattgtggaagtcagtgtggcgattcctcagggatctagaactagaaataccatttgacccagccatcccgttactgggtatatacccaaaggactataaatcatgctgctataaagacacatgcacacgtatgtttattgcagcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacacagcatattctcactcataggtgggaattgaacaatgagatcacatggacacaggaaggggaacatcacactctggggactgctgtggggtggggggatgggggagggatagcattgggagatatacctaatgctagatgacgagttagtgggtgcagcgcaccagcatggcacatgtatacatatgtaactaacctgcataatgtgcacatgtaccctaaaacttaaagtataattaaaaaaaaaaaaaaagacagactacttggtccacgcgatggaatactatatagccataaaaaggtagaagaacatcccttatgtactaatttaaaaataactcccaggtaaactattaactgaaaaagccaaacaaaatagtgaggtacagaatagggccttttatgtgcagtaaaaaatccagaaggatgtacaagaaaccaaggacagcaatcatctatttggcaggttgaggaagaagtaaatagcggacacaggtgaaagggagagtccctcatatcctcctttttatactttttggcttttgaatcatataaatgtattcaaaatggaaaatgttataaaataaagaaatcaatgaaagaatagcacatcactgaaaactgtatttctgttccaccttcagtcattaatttcaattgagaaatgtttctattcacatacaatgatgagaataaataattacaagaaggctagagaccacaaaaatagaaaaatgactctctggaatcttgcatttgttttctattgatgaaggaagcagtcggcatgctattttgacagccggtattacaagaacaagatactgctcagcagtgtttcaaaaatactggcaaataaagttgttttctgcctgttattttccccccacatccaatcctgatgatcgatccctattaattgtacaaaggaagcgaagttcaaggtggaaagattatttttctaagaggattgtatggggatatttgtattacgagccttctatggaaacttgaaaggtagaggatcgcccctggaatactgtttttgcttttcctccttgaaagcagttagcagagatacatgaaaatttcttttctctttccttttttcagagatgaggtcttagtttgcagtgcagtggcatgatcatagcttactgcagtctcaaactcctgggctcaagtaagccacctgcctgcctcattttttatcttttcagagataggggtctcactatgttgcccaagctggtctcaagtttggggcctcaagtgctcctcccctcctcagctcctgagtagatgggattacagaggcatgccaccatgcctggctctggcagtttctagaaatgttcataaagggagtttaccggggagtaccaccacaggccatgctcttcctgcttttgcctgtgagatctttgatcttttgcacctgatgttctaatagctgagatatcaaagaacgtgggacaccaccacaataaagtggggtgttttctctgagtcccagacacttatggattttctcataattcactgacgttcctcagacagtctcctgtcatttattactgtctttttgtagcttagcatctcttcacttcattggttcaaccaaagctggtatttccagacataaccctcagatctcatcacaaagggcgccaatggcaacctgcaagatcaaggcaaaggggacactgaaaaactgcaagaagaaatacgatctcttcttcccttgtggggtcactggctgaagaataatggccagggagaaaaattctgagatgaaagcaagacctccttccaccttgcaccccggtaacctgtggcgcgtgagctgagcacgtcctgttagatcttaattatctcctgctgaggggaggaagggggtttttatttggggagcagaaaggctcactctgctccagctatctaacataggacacagtggggagatcacggaaaggtgaaaggcatgactgcaactctgaaggaacacagggcccctccatctctccctccagctttctctcttccaactcaaaacctgcctgcatcatgaggtccaaattgtcacacctcagcctgtgcactcttccggctggaatgtccttccatgcctggctaccaaacacccactacccttcatgatgaaagcctggcccttgccacgtctccccctccaactcctgggctcaagtgagccacctgccctgctaattttttttacatcttttcagagatgggggtctcattcaccccatcccccagcggagaacatgcccactccctccttccacccctgccccacccagaaccaatttctaccccagcaggcctgatactgcaagttcactgatttgtctacacagctgcttccctcttttagaacctaacctaaccacctaacctttaatgttggattttttaaattaaaaaaatctgttcctcattggaaaagtgataatcattttagatatttttgaaatatacacaaaaactggaaacaaataagcaaaatttagttttttggcccctaacctgaagtatccatctacgaatggatggctatatgttcttccaatattttttatgcaaagatatgcatatatttagatgtttctttatcaaaagggattattgtctatgtattattttacaatgtgttcttttcacttaactatattgtaaggtaaggttaggtgttgctttgggtgctcccttggacatacctctattaataatatgacatctcattttatagtaaacatgagctcctttccttattcatctctacacttacaatgcctagcagagggcctgagatatatcaggtgtcccaggtggcgatgccccagtagggtttgatttcagaatagtcacaagtcccttctgacaagccactaccaggataagtacagacttttaaatcagctctggcagacagggccaggctatatgaggagggctgcaaaccgtaagcctttggaaccagacaggaaacatacatttaaaaaatggctcaggtgtaagggatggccagtggtgggggctgtgtctaagtagacagcaaatgtcctgcccaaaaggccagcgcttctcagttccagccaaccactgccctactggggtgcaggtcccatgatagctatcttccaactttttcagggaggcccagttaaactttggctcaggccacattaaatatatcttcagggcagacacgctgtttgtttcctgtgctgcaacatgctttatggcagaggtccccaacctttttggtaccaaggaccagtttcgtggaagacaattattccactgaccagtggggtttgggggatagtttcaggatgattcaagcacatcacatttatcatgcgctttatttctattattacattgtattatataatgaaatgtaattatacaattcaccataaagtagaatcagtgggagccctgagcttgttttcctgtaactagacggtcccatctagggatgatgggagacaatgacagatcatcgggcattagattcccctaaggcacacgcaccctagatccctcgcgtgcgcagttcacagtaagttcatgctcctgtaagaatccaatgccactgctgatctgacaggaggcagagctcaggcagtaatgtgagcgatggggagcggctataaatacagataaagctttgctcacctgccactcgcctcctgctgtgcggcccagttcccaacagtaccagtaccgcagactggcactggtgctagatgtgggggacccctgctatatggcatatctaactctccagttggtttttatagtgggcaaatatggtcatggtgagaagaaaaaagagactgaatgatgaatactcagtgtcagcttagatgctgacctttttcaagaaagacacaatttatagaacatgcctcatcccttctatgacagcggtggttcttcactgggggtgatgacatcccccgagggacatgtggcaatgtctggagacatttacagttgtcggaacttgtggctggggagggcaggggtggcatctggtggggagagcccagggatgctggtaaaaacacagtgcatagggcagcgcctcatgacaatccattatctggcccaaaatgtcaacagtgccgtgactgagaagccctgtattagaacagcggttctccatcctggttacaaatcaaaaacacttgaggaggttaaaaaaatactgatgcatggatcttactccaaaataagggaatcagaatctctgagagtggggcctcatgttttaaaagctcccacgtgatcctaaggtgcggcctgtattgagacccgtcacactgaaccatgagctgcctgcctgggcccataatggagctgtcctcctccccgccacagaacctacttggcatttcactgaaacaggtgctcaataaatatttgttgcctggaatgggggggatgaattagtcatctatcatcagtaccctacaaactgcagtgctggactcatactgactttcaacattctattggtggctgatggaagtttttttttttttctagtcaattatttagtacatcaaaaggatacaacttacagccatcagtccacagcatactaacatgcttctgttggaataattacttctgaaagtgaaaggtacagaaacaatctggaccatatattcacgccaaaggaaatttacagaattaactcaatttttttttggtcacccttcctggtcatatgcagtgagaagaattagaagtcgtacattaaatgcaggcctggaaacttccattgctatcactcaaggagatatacgaaaataaaaaaaaaaaatccaatccagagcaggaagaaaagtttaatatcaggaaaccactaacactaatcagatttccctataatcagaattatttgatcagtgacttatttacatctaattgagttatggggaattttcacgtcttgatggaaacgataaagtggtgagtggcgagcaaggatcaggtctttagtactgaaactggcaccatccaacctacccacttgccaactgctaaacaagagaatggtattacccctggatccctggggctctctgaggtcagtacagggcctccagctgggtgttgagaaagcctggggcctttatccagagccatggctgacagtgagaatgcaagggtccataacagagcccctgtccctgcagcttaatgagggaggtgccagagtaaatgagccattagaacaggtgaggtgagagccttgctaggcaagagcaggggcaataggggtttgcaggaagggcactaacacagccctggaggaagcaatgagctggagaaggcttctcagcagtggtgaaggagagacagccctgagagataagacagagcttagaagggagagactgctgcagataagagaaacaacacgtgcaaaggcccaggggcagggagagcttgatgtgttggggaactgcaagttccacttaccaagtggctctttaagaggtgagaggccttgtaatcccagcactttgggaggccgagacgggtggatcacttgaggtcaggagttcaagaccagcctggccgtcacggtgaaaaaccccgtctctaccaaaaatataaaaaattagctgggtgtggtggtgtttgcctataatcccagctacttgggaggctgaggcaggagaatcacttgaacccgggaggcagaggttgcagtgagccgaggttgtgccattgcactccagcctgggtgacagagcgagaccctgtctcaaaaaaaaaaaaaaaaaagaggtgggaggaatagggaggttgaggctggagaggcagccagggccagatggtaaaggccaaataaatgtctcgaatgagaagtgcatgtttgaagaggtagaaaaaaggtggacctcttaggggaggtacagagggagacactatttttcctttcttggtgtccatgtgtactcgacattggacagaccctacattcaaaagccagatcccccacttcctattgcatggccttgggcaagtgactaacctcatctgtattcaggaaataagaagaacacctatttcccaagggtgctgggaggatcaatgagataatatacacagggttgaggccgtgggtggaagaattgatgaaaccagggaaaatggctgaactcacattggggaaggtggagaattccaggggatcactgtgaaaaggaggaggtgaaaggttttagcttgtcaaagagttttttttttttttttttttttttgccccgaacttggagacaagaagagtggagaaaaaagggggcgagggagggagtacacataccaggaatatagccaccatttggcattttcccaaaatactgcagcagagatttaaaggatttaaattgcttttcactcatttttggatgttggcctgagatttctctgactctgggccaagctgccatgggtcacgagtgacacacggaaggccccattacctggaccttaataggctctcgacaaagcctgctgctgctgctgcaagttttatggttgtggttgtttttaaggctagactgtcacaagggtccctttccaggataagcattgctctgggtctccaaatccctcatccacttgttggaagccagggcatctagagatctgcctctgcagggaaggcactgtatgcctcaccccagctctggggcctggtggtttctctgtctctgcattgcaattgcatgagaatatcctccttgcctcacctacaccccagcagacaatgtgaggcctcgagtaacctgaataaaaggcaggtgtctgggggacaaacagtaggtccagaggtaagcagagaagcttacagtctgataactgcattctccagcttcgctgtttcagcagtgggatgcagccacagatgggcctggtaaggctcttattcaataagactcctgtacatgcaagatcaggggaaatgcaatttttaagataatttttttggtcagtgcattccctggaatagagactcatttggtctcaggacactagactatactgagtcaatttaattcttataacaggacaataaccgagactgatttataatgtaactttctggatattaaaatgttaatgaaattgttgtcatgaaaaataatggcttgtgtttttatttgaaccattctcaaggcccatcccttcttttaaaatttatttccactcacatgaagaaattgctttatcatctaattttaaaaaatcagtttctcccacccaccccccatggtgatttattttctctaaagaaaatgttaataactggccaggaatctaaatgctaaacacaaggaaaaatgaaatctttgaaaatgaaaataaatgatccatttttcttctttcagagaaattgctgctcctgaaagatataagatgtaggaagaagcagcagctaatgatctcaactctaagtcccttgaaagctgccactgggggttcatattttccttcccactatgccttgcacagacattcatggagtacttctgggtgctggcccttgcttaagaaatccaaagaccagagcagatgacagacacttctagcaaatcatcgtaataaagtgagaacaatgtctttaggagaaagaggcaccgaaggacttcagggagaaaaaccccaaagataaaaagggaagggatggtttcagaggaggggacattggaggaggctactgaccggtgagtaggacctgtccagctggagggaggtgtatgaaaagacaggttgtatgggggaagctgaacaccacaaactgaaaggaggtagagctgaagacacgtggcacctagaactgatcttctagttgacagagtagcatgagaaagggtcatttgctatgttacagaaacccttctgactgcagtgttgaagaaaacgaaggacataaggggccatcctgggaggccgggtaggacctactgctcgggtccaagcaagagatgggggcggggcctccacagggcaggtgccaaggactcctggaaggtgggatcagcaccaatggatgacccgtcacttagcatcaggttttcagggagagagcgtggaaagctgtgggctgacagccaattgtaaaatccacgctaagcaggaaaaagcaacccacctcctcccaaaaatgtgtcaggaacatggaaagaggtgggaggcatttagttaggaggaaaatggcaaagcaaactgggtaggaaagaagctgaattggtgtcagagtgtttcaggtctggaagaagtctttcctgataaatggtttttaagcctctcttgacatacttctggtgatggggagctcactacccatgcagacatcctatttcattgacactgcaagtaccttgaaccaccatcttttcctttggttccatatatacagcttcctttgaatttttactttcagttgcacaatgagacttcctacaaacccacttgatttagcaagaagacctgaatcagtcctctcatcctgctgatggaacatcttccactacagcaaggcaacagctaagaaaaagtcacagggaaggcgaacaacctgggcaaaaacttgggttttaagccactttagctgcctgaatcccctgccccatcccattaccgtgctgttgcagccagcaaagcaggcagacaggtaggtgatgccatctgccccacacactggagtgaaggaatcggtttggcattcacagttattattgcagggcgagtaggggtccagggctgagccaggtgctgtgctggaaaagaaaggaaacacggaagccattagaaacaggtcaattcggaatcagatgcccccagtgacagccttttgcctctgttgtgatgagtcgcgtggtaccctgcttatgggattgttacctggttctcccttcccttttcctttaccaacgttagcctatcctgtccagcaaggagcagcccagggccactgctgagagctacgtgggttgtgccctggccaatgatgccagcttgggtggtgggctgggtgggagctgagtccactccagcccctctcatgaagcgaggaggaagatgctttttatcactggtattgacgtgccctctgggctggtggcagttgggactgctcagggccaccccctccacgatgcctctcctgattgctaaggcctcagcttatccccctgtcctgaacactgctatgcctgcaccactgaggatttaacttcttccctctttgggctggttcttgtctctttgctttattcctcccctacagtcaggaagcctcatgatgcttacttactacactgcttcaaccagactgacttcaataattattgtctaattgattcaatgtcctgagaaaaataacactaaggtgttttaattttcctttgcatcattaaaggcaaagttatctagagcaagcaaactgaaaaaagaacaaaagggtagagtgagtgtattagctctataagagaggaaatgtctcttctttactctgatcattttcagctatgtctcctaaggctcagagcacttcataataataaaggtgacgatggcgacacccggcaatttatgcgtcatgcactattcaaagtactgcatggattatttcatttattctcattataaccccatgggctttagagaagaaaccgaggcacagccaggttaagtgacttgtccaaaagtacagaagtcataaatggtagaggaggcgctggaactaggactgtctgactgtaggatatacacttttcttttctttttcatggaagaataacgtcattatagtaagaccttgtgctcctaaccactaccctttactccttgggagttgagcagtctgctacttgagacagctgttatgcatagcaggtgcaaacgggaagaagacatatctgaacacgaagtcggggccaggctggggcggggattggaaggggcaaccccgtgatggtgtaaaggggaaggaggggcacatggtgcctggattgtacacagacatacagaaagctgcctctgttctgctctcccactctgcctgctcacccttgtgggtggcagagaagccctggctccactgcatcttccggcacaagcgcaggagcaggcctcgtggtctgcttggaggaagagtctggctctagagagagaaactggtaacctgcaggccagccatgcttcagcctcgatgctccaggctggatttccaaggcagcctcagtcccatgtggaaaaggggacagctattgatactggatagctgaagactccccataattccctctaagggcaattctcactggactctagtcccaagtcttgggataaaaactaggaagaaagaaaagtggtcctatgagaactaacttccttctcttcctccctccctttttctccccctttccctcgctacacttaagaacacctgccatgggccagatcctgtaattgccatgtgagcctaatgacagcttctgatagtttaaggaattgttgaaatcaaatcaattctgtcttttattttgagctgaattttgaattaaaatttttattttctctcttcacatttttcctaaagtcaaatgccaaaaatcgcgatgtgagtctgccagggaggaaacggcttctcttctcccccagtgcttcccagcctttgagtggaaaggtctgctttctcagcccagagggttctactgattctccaacgtggacagtaagatgcagaggcagccgtgatgcgtctcctcaggtcactaggaacaaagctggttccctcaacctactgcagagggagattgctagggtccctgaacaggcaggaaggcggcagacactgccagtactcacctgtttccatagggaacagtaaccccagccacagggccagtgtcgcagcccaggaagaggaaggagacgtagcaagcagtggacaccaggttgacgagcatggccatccgaatggcccccagggcagacaggctgagcttcttcaccaaaagacctcccaggaagatacccagacaagcacacgggatcgcagtcatccctggaaggaaaatagaggggcagggctgtgaacagggaaggtggggccagtctacagacaggcgggcagcaggcctgaggctgagtcccgtgaatgccctatgaccccactgtggtgtcactgcctccatgggaccctggagtcttcaggaagggcctgatttatgcccccagggagctcatggagaactgggggagacagacataaagcaactctgcttcatgaatctaagtgcacgcacctgtcctgctaagtggggcaccctcaggagaaacgcaagctgaagaggggactaccaagagatggagtcagagagactgggaacacagacatgccttcgggagggtacatatcacggagcagtgatgtgctctgtgagcatttttgagatgagatgtgggaagcggacttgagatcatttagggatttttctcctcgtcttctaatgaggcaagaagggagggtttcacggaaagtacggaggctgtttaacctaaaggtcacggaattcaccaggccatagagagagtgtttgaaccagctccgccacccctcaggaagtggcatcaatcaatatgttttgtagctcttggtgaataaatggcatatatattttttcctttctctctcttctacccagggctatctacaagtgagcaggaccataaacctgttatttctgattcgcagagaccatggcattttaggaggaccaaaggatcccagggttccaagctcctgcgttggttttgctccattctgattcatctcatctaaaactcagctttcaattgctacgtgtcatttatctaccatgtagatgatgcatggccaattttccagtctaggctgccttcttgccaatcaacagacctctaggtcaactgactacattaaccagctggtatgtgctaagggaatgcaaattaattttaatattggggtgagaaaatataataagggggtatagctctgcaagaaaacagcacaagtcatacttaaaatgacatataatatctctttatcatctgctgctcttggagtatctgtgcttggttttcttcccttggtataggagtgatgtcatgagccagctcctgggtgcctctttatcctcatcctgcaccgcactgcccatcccaaccatgccactgtccctcctttctctccctaggacaggccaaacagttctgcttccccaggctttgcacgtgcagttccctctcctgggacacttgcccgatgtgtttacttggctggcccctactctcttcagacaggtttcccaggccaccctatgtagagatccatgcatccccaccctgagattccatactgttttcatggctctctcagctctttgaagcagcctcatttatttttgggtttcttgtttcttgctctctctctctctctctgctaggatacagctttcctgtggacaaaaaccctttttgtcttgttcagtcccgcctagattctctgtgtctagcatggtacccagcacggagtgggcatccaagtattattttcagaatgaatgagctaaggaacagattggatgtgtgtgaatggacatcagtgacaacatgcccacacccagaaagcaggcctgtgttttgtttcatttcctagcagagacagtgggggtgtcacctgtcaaggatggtaaccatggcaatcacaggctttcacaccttttctccaagccattgtcaggccccctccctccctgatgtatgtgctgtccttaacactccaggcggtgatcagaacttccctgaaattccattctcattacgttaacctatgcagattgagtcctttttatcttcactcacaaatcagcaccaccagctctttaatcacctgtgttgctcttctctgagctctgccccatttgctgatgacttcgcaaggggtggaaggggggccagtgctgatgctctgggatgactgcctgggcctcatctcccaagtctgccttctctaaccgcccactgccagcccctcctgcagccagcctccagcgtccacactgactagactgtcaccaagggcagggcacacacagagggcacctgtgctgcttgcctggactgcccagctcaggagaaggtgcctcctgccaagcacaccagcagacagaaatcactgggagacagaaaggcgcaataaggcagaattgtttttttgaccttctgccctgaagactattgatttgtttgtcgatagaagatgtaggcatctgttctgaaacagagcactgcccaaagttgaagcaactgtgcaaatggaatcaaaatggaagaaaaagcagcagaggagtcagcaggtgagagataaactcttcaggtgctgaagggctaaacctgagatcctggggataacaaagaagttacaactttaattataaagaggtgtattttaccctatctctgtcgggcagatattaaagggctgactgcattttgccaatacctcttggaggtaaaattgaccaagtggtgggtggtagagagttctttgtgtaaaagaaaaacataagacttgtggtaccctggcagttcccagggagaggggtggtaatctggccatatcattgtgatagggttttacattttattttatttatttatttattttatttttcgagacaaagtctcactcttgtcccccaggctggagtgcaatggcgcgatctcggctcactgcaacctccacctcccaggttcaagcgattctactgcctcagcctcccaagtagctgggatgacacgcctaatttttgtatttttagtagagatggggttttaccatgttggccaggctggtcttgaactcttgacctcaggtgatccacccacctcagcctcccaaagtgttgggattacaggtgtgagccaccacgcctggcctactttttcttttaaactgagatatgttatgtcctgtgaagtacacagagcttaagggaacagcctgatgaacttttgcgtctgtacacacccctgtaactacagctcagattaaccttagaacatttctagcagctcaggaggctccctggtgtgcctcccagttagcttcccccaaaggtaaccactattctggcctctgtcacctcaattaactattcctctttttaattcatctaaatatgtgctcttttgagtctcatgtctttcaactctgtgagattcaaccacattgaggcatgtatcaaagttctttccttctcattctgtgcaatagtttaccatagaacattctataatttatccattttacattgacggacatttgggttgtttcaagtttgggtccattatgcataaaacagctctggacattattacatatgctatgtaaatgagtgaacataaacacttatttctgttggacagatgaccagaaatggaactgataggtcacagcacagacatatggttagctttaataggcacagccaaagagttttccaaagtggcagcacccatttgcattcccactggcgaagtatgcaagttccagtggctccacatcctccccaacacttggtgctatcagtctggtggatgtttagcagcacctcattgtggttccaatgtacatttctctgatgactcatgatggttagcacctttgtgtttgtttcttggccatcttgtgacatgacaggagattttaaaagggaagatcagaaagcatcaccttccctttcctctcagcagacaatctgactcc

SEQ ID NO: 111 - DNA, 2276 bp, Homo Sapiens
gcggccgcattcctgcaggggatgactgtgaatggcttcatcaacacagtcatcacctccctggagcgccgctatgacctgcacagctaccagagcgggctcatcgccagctcctacgacattgccgcctgcctctgcctcaccttcgtcagctacttcgggggctcagggcacaagccgcgctggctgggctggggcgtgctgcttatgggcacggggtcgctggtgttcgcgctgccccacttcacggctggccgctatgaggtggagttggacgcgggtgtcaggacgtgccctgccaaccccggcgcggtgtgtgcggacagcacctcgggcctgtcccgctaccagctggtcttcatgctgggccagttcctgcatggcgtgggtgccacacccctctacacgctgggcgtcacctacctggatgagaacgtcaagtccagctgctcgcccatctacattgccatcttctacacagcggccatcctgggcccagctgccggctacctgattggaggtgccctgctgaatatctacacggaaatgggccgacggacggagctgaccaccgagagcccactgtgggtcggcgcctggtgggtcggcttcctgggctctggggccgctgctttcttcaccgccgttcccatccttggttaccctcggcagctgccaggctcccagcgctacgcggtcatgagagcggcggaaatgcaccagttgaaggacagcagccgtggggaggcgagcaacccggactttgggaaaaccatcagagacctgcctctctccatctggctcctgctgaagaaccccacgttcatcctgctctgcctggccggggccaccgaggccactctcatcaccggaatgtccacgttcagccccaagttcttggagtcccagttcagcctgagtgcctcagaagctgccaccttgtttgggtacctggtggtgccagcgggtggtggcggcaccttcctgggcggcttctttgtgaacaagctcaggctccggggctccgcggtcatcaagttctgcctgttctgcaccgttgtcagcctgctgggcatcctcgtcttctcactgcactgccccagtgtgcccatggcgggcgtcacagccagctacggcgggagcctcctgcccgaaggccacctgaacctaacggctccctgcaacgctgcctgcagctgccagccagaacactacagccctgtgtgcggctcggacggcctcatgtacttctcactgtgccacgcagggtgccctgcagccacggagacgaatgtggacggccagaaggtgtaccgagactgtagctgtatccctcagaatctttcctctggttttggccatgccactgcagggaaatgcacttcaacttgtcagagaaagcccctccttctggttttcatattcgttgtaattttctttacattcctcagcagcattcctgcactaacggcaactctacgatgtgtccgtgaccctcagagatcctttgccctgggaatccagtggattgtagttagaatactagggggcatcccggggcccatcgccttcggctgggtgatcgacaaggcctgtctgctgtggcaggaccagtgtggccagcagggctcctgcttggtgtaccagaattcggccatgagccgctacatactcatcatggggctcctgtacaaggtgctgggcgtcctcttctttgccatagcctgcttcttatacaagcccctgtcggagtcttcagatggcctggaaacttgtctgcccagccagtcctcagcccctgacagtgccacagatagccagctccagagcagcgtctgaccaccgcccgcgcccacccggccacggcgggcactcagcatttcctgatgacagaacagtgccgttgggtgatgcaatcacacgggaacttctatttgacctgcaaccttctacttaacctgtggtttaaagtcggctgtgacctcctgtccccagagctgtacggccctgcagtgggtgggaggaacttgcataaatatatatttatggacacacagtttgcatcagaacgtgtttatagaatgtgttttatacccgatcgtgtgtggtgtgcgtgaggacaaactccgcaggggctgtgaatcccactgggagggcggcgggcctgcagcccgaggaaggcttgtgtgtcctcagttaaaactgtgcatatcgaaatatattttgttatttaaaaaaaaaaaaaaaaaaaaaaaaaaaaaaaaaaaaaaaaaaaa

SEQ ID NO: 112 - protein, 612 aa, Homo Sapiens
AAAFLQGMTVNGFINTVITSLERRYDLHSYQSGLIASSYDIAACLCLTFVSYFGGSGHKPRWLGWGVLLMGTGSLVFALPHFTAGRYEVELDAGVRTCPANPGAVCADSTSGLSRYQLVFMLGQFLHGVGATPLYTLGVTYLDENVKSSCSPIYIAIFYTAAILGPAAGYLIGGALLNIYTEMGRRTELTTESPLWVGAWWVGFLGSGAAAFFTAVPILGYPRQLPGSQRYAVMRAAEMHQLKDSSRGEASNPDFGKTIRDLPLSIWLLLKNPTFILLCLAGATEATLITGMSTFSPKFLESQFSLSASEAATLFGYLVVPAGGGGTFLGGFFVNKLRLRGSAVIKFCLFCTVVSLLGILVFSLHCPSVPMAGVTASYGGSLLPEGHLNLTAPCNAACSCQPEHYSPVCGSDGLMYFSLCHAGCPAATETNVDGQKVYRDCSCIPQNLSSGFGHATAGKCTSTCQRKPLLLVFIFVVIFFTFLSSIPALTATLRCVRDPQRSFALGIQWIVVRILGGIPGPIAFGWVIDKACLLWQDQCGQQGSCLVYQNSAMSRYILIMGLLYKVLGVLFFAIACFLYKPLSESSDGLETCLPSQSSAPDSATDSQLQSSV

SEQ ID NO: 113 - DNA, 1838 bp, Homo Sapiens
gcggccgcattcctgcaggggatgactgtgaatggcttcatcaacacagtcatcacctccctggagcgccgctatgacctgcacagctaccagagcgggctcatcgccagctcctacgacattgccgcctgcctctgcctcaccttcgtcagctacttcgggggctcagggcacaagccgcgctggctgggctggggcgtgctgcttatgggcacggggtcgctggtgttcgcgctgccccacttcacggctggccgctatgaggtggagttggacgcgggtgtcaggacgtgccctgccaaccccggcgcggtgtgtgcggacagcacctcgggcctgtcccgctaccagctggtcttcatgctgggccagttcctgcatggcgtgggtgccacacccctctacacgctgggcgtcacctacctggatgagaacgtcaagtccagctgctcgcccatctacattgccatcttctacacagcggccatcctgggcccagctgccggctacctgattggaggtgccctgctgaatatctacacggaaatgggccgacggacggagctgaccaccgagagcccactgtgggtcggcgcctggtgggtcggcttcctgggctctggggccgctgctttcttcaccgccgttcccatccttggttaccctcggcagctgccaggctcccagcgctacgcggtcatgagagcggcggaaatgcaccagttgaaggacagcagccgtggggaggcgagcaacccggactttgggaaaaccatcagagacctgcctctctccatctggctcctgctgaagaaccccacgttcatcctgctctgcctggccggggccaccgaggccactctcatcaccggaatgtccacgttcagccccaagttcttggagtcccagttcagcctgagtgcctcagaagctgccaccttgtttgggtacctggtggtgccagcgggtggtggcggcaccttcctgggcggcttctttgtgaacaagctcaggctccggggctccgcggtcatcaagttctgcctgttctgcaccgttgtcagcctgctgggcatcctcgtcttctcactgcactgccccagtgtgcccatggcgggcgtcacagccagctacggcgggagcctcctgcccgaaggccacctgaacctaacggctccctgcaacgctgcctgcagctgccagccagaacactacagccctgtgtgcggctcggacggcctcatgtacttctcactgtgccacgcagggtgccctgcagccacggagacgaatgtggacggccagaaggtgtaccgagactgtagctgtatccctcagaatctttcctctggttttggccatgccactgcagggaaatgcacttcaacttgtcagagaaagcccctccttctggttttcatattcgttgtaattttctttacattcctcagcagcattcctgcactaacggcaactctacgatgtgtccgtgaccctcagagatcctttgccctgggaatccagtggattgtagttagaatactagggggcatcccggggcccatcgccttcggctgggtgatcgacaaggcctgtctgctgtggcaggaccagtgtggccagcagggctcctgcttggtgtaccagaattcggccatgagccgctacatactcatcatggggctcctgtacaaggtgctgggcgtcctcttctttgccatagcctgcttcttatacaagcccctgtcggagtcttcagatggcctggaaacttgtctgcccagccagtcctcagcccctgacagtgccacagatagccagctccagagcagcgtctg

SEQ ID NO: 114 - DNA, 4068 bp, Homo Sapiens
aagtgacccagggagacaaacacttggagatacttggggctgagtttgagcaagactccctaacctgtgtctggacaagtctgatgtcctgtgtggcccaagaagaactgaccccgtgtctggagctcccaccgttattgcatccctgctgtggctcacctgctgctgtctccaggagcccctgagaagatttgcctcctctcccctgctaagctccaggtcctgagattgaattaggggctggagctcactgcactccagcagtcatgggacccaggatagggccagcgggtgaggtaccccaggtaccagacaaggaaaccaaagccacaatgggcacagaaaacacacctggaggcaaagccagcccagaccctcaggacgtgcggccaagtgtgttccataacatcaagctgttcgttctgtgccacagcctgctgcagctggcgcagctcatgatctccggctacctaaagagctccatctccacagtggagaagcgcttcggcctctccagccagacgtcggggctgctggcctccttcaacgaggtggggaacacagccttgattgtgtttgtgagctattttggcagccgggtgcaccgaccccgaatgattggctatggggctatccttgtggccctggcgggcctgctcatgactctcccgcacttcatctcggagccataccgctacgacaacaccagccctgaggatatgccacaggacttcaaggcttccctgtgcctgcccacaacctcggccccagcctcggccccctccaatggcaactgctcaagctacacagaaacccagcatctgagtgtggtggggatcatgttcgtggcacagaccctgctgggcgtgggcggggtgcccattcagccctttggcatctcctacatcgatgactttgcccacaacagcaactcgcccctctacctcgggatcctgtttgcagtgaccatgatggggccaggcctggcctttgggctgggcagcctcatgctgcgcctttatgtggacattaaccagatgccagaaggtggtatcagcctgaccataaaggacccccgatgggtgggtgcctggtggctgggtttcctcatcgctgccggtgcagtggccctggctgccatcccctacttcttcttccccaaggaaatgcccaaggaaaaacgtgagcttcagtttcggcgaaaggtcttagcagtcacagactcacctgccaggaagggcaaggactctccctctaagcagagccctggggagtccacgaagaagcaggatggcctagtccagattgcaccaaacctgactgtgatccagttcattaaagtcttccccagggtgctgctgcagaccctacgccaccccatcttcctgctggtggtcctgtcccaggtatgcttgtcatccatggctgcgggcatggccaccttcctgcccaagttcctggagcgccagttttccatcacagcctcctacgccaacctgctcatcggctgcctctccttcccttcggtcatcgtgggcatcgtggtgggtggcgtcctggtcaagcggctccacctgggccctgtgggatgcggtgccctttgcctgctggggatgctgctgtgcctcttcttcagcctgccgctcttctttatcggctgctccagccaccagattgcgggcatcacacaccagaccagtgcccaccctgggctggagctgtctccaagctgcatggaggcctgctcctgcccattggacggctttaaccctgtctgcgaccccagcactcgtgtggaatacatcacaccctgccacgcaggctgctcaagctgggtggtccaggatgctctggacaacagccaggttttctacaccaactgcagctgcgtggtggagggcaaccccgtgctggcaggatcctgcgactcaacgtgcagccatctggtggtgcccttcctgctcctggtcagcctgggctcggccctggcctgtctcacccacacaccctccttcatgctcatcctaagaggagtgaagaaagaagacaagactttggctgtgggcatccagttcatgttcctgaggattttggcctggatgcccagccccgtgatccacggcagcgccatcgacaccacctgtgtgcactgggccctgagctgtgggcgtcgagctgtctgtcgctactacaataatgacctgctccgaaaccggttcatcggcctccagttcttcttcaaaacaggttctgtgatctgcttcgccttagttttggctgtcctgaggcagcaggacaaagaggcaaggaccaaagagagcagatccagccctgccgtagagcagcaattgctagtgtcggggccagggaagaagccagaggattcccgagtgtgagctgtcttggggccccacctggccaagagtagcagccacagcagtacctcctctgagtcctttgcccaagattgggtgtcaagagccctgtgttccattctggctcctccactaaattgctgtgtgacttcaggcaagacattgatcctctctcagcctttgcttgctagtctgaaccaaagagttgtttgggcatttgctgtgttggccatttctggagcaagagggtcttcttcctccttcccccagccagccagctgtcctggggccaggctttcctgggtggaaagaagtatacctttccctggggccctaggatagcaaagtgagccatagtgggccaggctgccctccatgctgggccccagcccaggtctgcactcgcctggatcaccttctttgagccttagccatctcctgtcaggtaggaatgaacttgccagccttcaggctcgttcagctatgaccatctgtgcggtcagggtacactcagctctcctccccaactccagcagcctttaagaagtgtccctttggcgccccctggaggcagagcactgagctggaccctgggtagactcccacagggaggacggagctggcctcaggagtgggacacccagacttggcagggccttcaagaggcctgtgtgggggccccaggaatccttagctgaagcggggagactcactctccatctcaggaaattctagcccttgccctcagggagccacggttgagggtgaggcccaacacctgccttagggccctgggtgggcaagtctgggccctggggtagggagggagactcaggcccacacttgggtattttctaatttcagacaaacacacactcagcgcgcactcactgattcctacacattgccaagatttcacacatgtgaccaggggccaccaaagtccctgtgacctttgtgactaggatcctaatttctctattttctcctgggtgcctgggtctgtgtcacctggggcagtgtggataatgtttagttctgtgacactgttttttgggggtggcacctggttctccgatgcctgggctggtgtcaggcccaggactgtagtgctgggagcagtaaagctcagctctgtgtaatgagtgatgctatggcttgctcgtgtcttatgatccaatccttttctacatcagcccttgttttgttttatggctagtcttatctggcctggttatttccttgcggggaggagagggtttgctaatctgctcccagcccaacctattaccaccccacctcgctgggacctactgctcgggaggcagcagacagggagccaccagcagtggcttcctggccctgtgctgggggtggggggaagctgggggcacatgtggcccttgccttctgagcagctcccagtgccagggctttgagactttcccacatgataaaagaaaagggaggtacagaagttccaattccctttttattttgctggttggtatctgtaaatgtttaataaatatctgagcatgtatctatcaacgccaagaatttcaaagtctccttcaacaatatgaggcttttaggatgtttatattccttcatccctcttgtttcccaggttttgcagggaaaaaaagtctggaattatagatacagcttattattaaatttgttcttgcat

SEQ ID NO: 115 - protein, 709 aa, Homo Sapiens
MGPRIGPAGEVPQVPDKETKATMGTENTPGGKASPDPQDVRPSVFHNIKLFVLCHSLLQLAQLMISGYLKSSISTVEKRFGLSSQTSGLLASFNEVGNTALIVFVSYFGSRVHRPRMIGYGAILVALAGLLMTLPHFISEPYRYDNTSPEDMPQDFKASLCLPTTSAPASAPSNGNCSSYTETQHLSVVGIMFVAQTLLGVGGVPIQPFGISYIDDFAHNSNSPLYLGILFAVTMMGPGLAFGLGSLMLRLYVDINQMPEGGISLTIKDPRWVGAWWLGFLIAAGAVALAAIPYFFFPKEMPKEKRELQFRRKVLAVTDSPARKGKDSPSKQSPGESTKKQDGLVQIAPNLTVIQFIKVFPRVLLQTLRHPIFLLVVLSQVCLSSMAAGMATFLPKFLERQFSITASYANLLIGCLSFPSVIVGIVVGGVLVKRLHLGPVGCGALCLLGMLLCLFFSLPLFFIGCSSHQIAGITHQTSAHPGLELSPSCMEACSCPLDGFNPVCDPSTRVEYITPCHAGCSSWVVQDALDNSQVFYTNCSCVVEGNPVLAGSCDSTCSHLVVPFLLLVSLGSALACLTHTPSFMLILRGVKKEDKTLAVGIQFMFLRILAWMPSPVIHGSAIDTTCVHWALSCGRRAVCRYYNNDLLRNRFIGLQFFFKTGSVICFALVLAVLRQQDKEARTKESRSSPAVEQQLLVSGPGKKPEDSRV

SEQ ID NO: 116 - protein, 670 aa, Homo Sapiens
MGETEKRIETHRIRCLSKLKMFLLAITCAFVSKTLSGSYMNSMLTQIERQFNIPTSLVGFINGSFEIGNLLLIIFVSYFGTKLHRPIMIGIGCVVMGLGCFLKSLPHFLMNQYEYESTVSVSGNLSSNSFLCMENGTQILRPTQDPSECTKEVKSLMWVYVLVGNIVRGMGETPILPLGISYIEDFAKFENSPLYIGLVETGAIIGPLIGLLLASFCANVYVDTGFVNTDDLIITPTDTRWVGAWWFGFLICAGVNVLTAIPFFFLPNTLPKEGLETNADIIKNENEDKQKEEVKKEKYGITKDFLPFMKSLSCNPIYMLFILVSVIQFNAFVNMISFMPKYLEQQYGISSSDAIFLMGIYNLPPICIGYIIGGLIMKKFKITVKQAAHIGCWLSLLEYLLYFLSFLMTCENSSVVGINTSYEGIPQDLYVENDIFADCNVDCNCPSKIWDPVCGNNGLSYLSACLAGCETSIGTGINMVFQNCSCIQTSGNSSAVLGLCDKGPDCSLMLQYFLILSAMSSFIYSLAAIPGYMVLLRCMKSEEKSLGVGLHTFCTRVFAGIPAPIYFGALMDSTCLHWGTLKCGESGACRIYDSTTFRYIYLGLPAALRGSSFVPALIILILLRKCHLPGENASSGTELIETKVKGKENECKDIYQKSTVLKDDELKTKL

SEQ ID NO: 117 - protein, 643 aa, Homo Sapiens
MGLLPKLGVSQGSDTSTSRAGRCARSVFGNIKVFVLCQGLLQLCQLLYSAYFKSSLTTIEKRFGLSSSSSGLISSLNEISNAILIIFVSYFGSRVHRPRLIGIGGLFLAAGAFILTLPHFLSEPYQYTLASTGNNSRLQAELCQKHWQDLPPSKCHSTTQNPQKETSSMWGLMVVAQLLAGIGTVPIQPFGISYVDDFSEPSNSPLYISILFAISVFGPAFGYLLGSIMLQIFVDYGRVNTAAVNLVPGDPRWIGAWWLGLLISSALLVLTSFPFFFFPRAMPIGAKRAPATADEARKLEEAKSRGSLVDFIKRFPCIFLRLLMNSLFVLVVLAQCTFSSVIAGLSTFLNKFLEKQYGTSAAYANFLIGAVNLPAAALGMLFGGILMKRFVFSLQTIPRIATTIITISMILCVPLFFMGCSTPTVAEVYPPSTSSSIHPQSPACRRDCSCPDSIFHPVCGDNGIEYLSPCHAGCSNINMSSATSKQLIYLNCSCVTGGSASAKTGSCPVPCAHFLLPAIFLISFVSLIACISHNPLYMMVLRVVNQEEKSFAIGVQFLLMRLLAWLPSPALYGLTIDHSCIRWNSLCLGRRGACAYYDNDALRDRYLGLQMGYKALGMLLLCFISWRVKKNKEYNVQKAAGLI

SEQ ID NO: 118 - DNA, 31124 bp, Homo Sapiens
tactttacagagaagacgaagtctgtggagctgtagctgcccccatgcctggctgtatcaccacattctcagtagcttccatcacgtgtccctccctctgctctttcaggagaacaggtgaactcctctgtcaagggctgtccaccacattccctctctctgctgcaaatccccagctgtgggctcctttccctccactgagaaacctgctcaagtctttcctgtcccagcaaccacatagtcaccactccctccctcgactccaacacatgccacaggccatgtcctctctcctttctcccctggctaagtcccgtgctcactgtctactccttccctctcgtgggcttccctccacaccacagaacgggtgccaccgctgccacttcagggacacagccctcacacaggctgcaagctgtcctcatcattaaagccaacagagacatttgggccctcaccttgcttgactgctcacattgcagatggctgctttcttcttggaatcatctcacccttgacttccatgatccacattctctgcatttcttttgggtgctgttgcttaaatttctctgcagactcctctatttcttcaggttggggtttcacctatctttttttaactctacacattttttcctacgtaaattccactccgatgtcctcaactaccatccatttactgaggcaactgaacctccactactacatataatatcgattatcatcccagagacccttcttgacccctcggctgaatactggacatcacttagatatgctatgggcatctcacactcaacagcttcaggtctgatccagaaactttgcatggatctgattcttctttgttatttccagtctttacaaatggtaccacaagctctccaagccagaaacctgagagccattgttgattcttccctcttgtttgactgctatgtctgttgctgttgtgtccactacttatcaacatctcagctgattaactcaacaaatgcagcttcctgtcatttgaagtaaaggatgatatattgtcacaaaacaaaaagcaaactaagacatgctgcaggaccacattccttaccctgcctgagcaacactgcttctcatgagtgcaaattggttttctttagtatgtcaactctgaacaattgggagtagaaacctgtagtctatgatttaaagaactgtaaagccatgcctgaccttggggagaaggagtgtcatgatccattagttatgtctgttgtgggcacagggaggagtagggagtgtatggcttccaagctctgcagttaactatgggtctcatgctgccaagaatattcttaactttatgtggctgattaaaacctgctaacctttcaagatttatccttcttcatcatagcttcctcaaatttcccatttcacacccatctatcgacttactggcctctcaaatgtacattttatattttcactctttattatcatgtgcttttagcaactgatccaggcaggcaaatcttactctgagaatatactttaaattccttgtgcacagaggccacatatatcttgttgctgtaggcccagagcagagtggggttcttcagcagggctcagtaaatttttagtgccttacacacaggacaccctcccccgaccctctcaggaggcctgaggacacactcaccaagcagctggttggcagaagaggtggtgaggttaaactgctgctccaggtacttccccaaaaaggcagcgaagccagccaccactgcaatctccatgcaggcggccaggatgatgcaggtgaacacagggtttgagagcaggtgcttggtgaccttcgggatcactgcagggagacagaaggcagatggtcagggtcaaggtcacaccctgtgctcccatcttatagccccctgctcctaaggccccttcttggcccgctcttgtccatttcagcaaacagcatccagaggtacccagttgctaaggccaaaatctacaccccataagtcatccatgattgtgaaatctctggcttcaaagcatacactgacatgttgccaattactatcttctactaaaacaggagagactataccaggacttttcttacagttcactagacacactaaaatttttttaaagcaatgtcagaagatattttcatcctctactaacagagggtttggggtttgtttctcaaaagaaaaaaaaatgtgtgtgtgtgtgtgtgtttatataaaataaagtataaatatcaatatatttaagtatatgtcaatatacctattgatggatctatatatatatatgtgtaagaaaatatacttaacagtttcaagaaagatatgaaattcttgtgctctccaaaatgtgtacatgcctaataaaaccccttcttgccatcttcatggctacctctctggcaaaatttccatcagctctcacttggagaccaccagagccacccaactggggtcttggttttcactcttgatccaatataataattccctgagtagcagtcagcgagatcagctcaaatcagtttcctgctcaaaaccctgcaatggtcaaaatccataggctgtgccatggcccgaggtctgcccctcagtgatctgatcacaccccctagcccctcctcttcccaccctccagtccagccccagtggctcttgctgtttctcgcctgcacccaggtccaccccacccaggtctttgtccttgggggtcttccctatacaagaatgctctgcctgtagatctttgctgaatgtgtttccttctccttagggggtctcttctcatcacccagtctaccctagaagaagcctcccactcagtcctggtgctcagggcttctatgagagctggtgatgggcaaaagtgctctgaggttcatgcaccactttaaataatgacagagccggaaagcaggaattgttgaggtcttgtacttcattctttctttattttactctatttttcttaaagcatgtggttttatatgccactaagactttcccttaaattggtgcttttaaaataggagattcattttttaaaaatcctttgaaaacaagcacattatttggatattcccagcaatcagaatcattggcatgtggtcttcagccaagtctcctaaattatggtatgacgtatcctggcagtgtacaagagagctctggggcaccaggacaaccctgtcatttcaatatttgtgccatgattttaatatgtccttacaacaaagctgaaatacagctgatacatcgaatgcgtggtttcatggctgttatggcttaagacactgctaggctacaaaaagtaagtagatttaaagttatttaaagagaagtcttaagtgcataatggttcaggtggaatgcaaataaagcaaaaattatagaggtggtttcccagagactagactaaagttagggaagtctgtgctgctgcgatcataaagtgtggagtatctgacatgcagtttacttgtttccacctatgcaaacagaacagataaaacacagagtcccagaggaaggaggtactacaccacgtctaggaaaaactgatcagtgccgtggtggcatgcaaaataaacaggtgggcagggagtctcacactgcattccaaggtgatgaattagccagctgtcctaaagaagagagctaattatcaggctcaatctcatctcgtaggagatgaaacctctaagcggcccaactcatcagaataaaataataataggggatgcataagtttttaataatgttaacagacaagctcaataagtcaagaactggcagatatacaaaacttagaatttaccatttccaggaatggtatcaagtttcaagaatgaaaatctacacagaagatcggcatcttagggttctttgacataacaaaaagaacttagttatgcaaatggactgagccagatgaccaaaagcttggaattggcaaagcctgagcaaccgaatcctgtgttataaccagatgataaccagagctggtggccttggctgttctgtggtggttccttgtaaaattcctgaaacattagaaaggcaactctctgatgaaataaatgcacaaataaaaataacacttttaaaaggctatgaataagaataaagataataagaaaacaacttcaagtccattgtattaatacacttataccctcctcgattttaagtgtactggtctttatgtgtgtgttttgtctatttttacaaggtttaaagcatttaccatcatctgaatttttagaaatatcatttcaaataaatatttagaagtgtttacctttataacacctatatgtaaatgttgggaaattttcctgtgttaaatccacattatgtttaaagtatggtacaaatatttagagtaatcctgactgtgaaatatttaaatatgtggattgttcaacaaatacagatgaattcattgggcataaacagaggacaatgaggtaagcatttatcttcatgtacagaagccccttggatgttacaactctatcctcataaatcactatgaatgagtgaaatctgatttgctatactgtgtggcacgttctgatggtgtagtgtacctgtggcaggagacctgtcggccatgccacacaacaacaagtttcacaatgtagtaagagcagtatggatcacgtcgggttataacagtgcctccttgtaatgaatacatttgaatgtcccggtggtttatgtgttttggcaagtaataacgccatttctcaatcacagtgctcttttggaataaagatatctaaattctggaaacattgccaatgtcaaacaggcaggctggggacattccaggaaaacgatcctctgccgtgctttcactgtagccttcatttttttcattagggtgcagaatctgcagagtctaggactcctggagaataaagcatcacagccacgcttggtcacaagtaaaactgctgccgggctgaggctgatacctccagcatttgctgattagcaactttgctctttggctcagaaatgacactgatgatgatttcagttttatcacattatctatttaggtcctggtatctccctgtccttgttcagagtcatcatgatttgtttggggatgaggaaggcactgttcaacaaaggcaactccggttaatggaatgcttttatacttcagcaagcaatttaattattctggagataattccacttcagcgggaaggattccttgtcaagatagaagtctgcctgcttttgtcttaatatctaataactaatttctccttgaattagatgtgaaaaatcattaggtttgagaatgatttgactgaatcatttgacttgaggaagccttagtgggccttatttgcatgaagaacattctttttttttccctctaccaaggcaacttgcctccagaaatgacagtttcctcttgggttcgctatttccttccaagttcttcctcccatccccagttttattgcaatgacttgcagcaccctcaaaagatgattgcttttcaaaggttcagcctaccttccaaaaccctagtttgagaagggctattaattagtttgctcctagggccaaccctgtgtttcaagcttttgcattcaaacagattgttaagcctataaaattctgactttttaaggaggcagcagctaatggggcggcccaggcaaacagaaactggtgaaccaaggccacaccaggccattgaacacctgcagactctcttagccatgtaccccccgcctaccgatttagcctcagaacttgggagctggaggtgggaggtaggctggcttgaattatgcagcctcaccagctgcagaaaccttttcaactctcattaggagcttggtactgtcaccagcaagatgacacaaaggtggaaagagcggcaggagagcggtctctagggaaaacaggttttctactgctagtctttaagagattcctgtaggattaagagttcttggaaacttatgggtccttcaggacggagaaaggcagattttggaggagtcatgaaaactaacgttgacagagcatttcctttgtgcaaaaatgccgttctaaatgcttacctatctgctcccacaatgctcacagcaaacctgtgatcttgggactattaaatcccccatttacagatgaaaaagctgaggcagagagaggtcccatggttagagcagcacagcagaaactgaaaccctggtacctgctgccatggcatgtgcttgtcaccagtatgctactctggtctggcttctgagctgctcttggtttgaagattaagcatgcaggccactcctggtagtcaaaggtgcagcttaattctaagaaataatgatagtaatagcaataataataataaaaaatttctgcctaggttggggaaaatgaccagatctggcatggatctgggacttagtccatttttttttttttttttttttttttttgagggaagagaactagggaagagagggagggagaaatattaataaaaggaagaaagaattgtagagctgaaagaggaggcttgtactgtagaaaaggttttgctgaatgaggttgtataaaataatggctaagaacctggtctaaggagtcaggtaatcaggattgaattctggcttcaaggctttagtagatatggaagtgactggagcacagaactccaccccacagactgctataaagatgaaatgagacccaagtgtgtaaagcatgtggcccagtgtctctggcacacaggtgtgagctcagtaagaataataataattaatataaaagaagtgatccacggtcaagtcatggaggaaaccctcaggctccttgtcatgtgtagtgttcctcagagccatggggatacacgacttgctgcagatgtatctgtgtgcgctgcttggtgagctagcagagaagggaaagaaggtgaagtggggcagccatagccatggagaaagtgggctgggctgagttcctgggccatctctgtggtcaagaagagctcctacctccagagggccaggcagcaggccaggtcaggaagcaatgtacttgtccatggccttggtttccatgtccagttccccggaattgaagttgcccaaggcagtggttatcatggggctcagtgtacctgctggactctcggtgtatttctgctttcaatcttctctactgaagttggccttgactttttattttcctttgataacattgctgtcaacacaccactgtcacggctcccaagaaggggagatgaagctaatgcatgcaactgctcagtaattacaatggtagccaatgctttttgggttatcgtcttaacattatcattccagacatgagaaaaccaacgcttcattgagaggctataaattccaccttgcccaagaatgcagagctgggaggtgagggagggtggatttgaactaaggtcagcctgagctccaaagtccatgtgcttaacattcaggtattttgtggggaattgaatctataaaagttgtttttctgaatgttgagttgccatgaggagcttcccaacacatgagacccacagacagaagagaacagagagcagggaggtcttagatgagataaatgacagtcttcaaatcataacttaaaaaaagggaaagaggaagaaataataaagatgtagaaaaatactgtgacggaagcatgggtgtgaatccaaggtggggtgacccctaggagaaacggtgtcacggaatagcatcaaggtttagcaaccaccgagttggttgctaatgtgccccgtgcaggctggatgcccttgcctgagtccttctcatctcccaagccagaagccacgtgggaccaaggatggagcagttctgtcattagatgtgagcaccacgccccgtaagagcagacacttaacaaactcaaggggtattaaagaatctaataaataaattttaaaatgaatgaatgaattgcaaagctttgaagggtaactgttatagcctcgtaagaaacactaactgaggcaacagaaaaaaacttatgaaccaaccatcagtgacatgccacaggttcactgtctgggtggaaacatattcagacccttgcttatacagtcagggggagcttatttgttaggtcagttccctgccattacatgccccctgcctgtacaaatgcaggaggaccagctctgacctgttggcccccaggggagatcaaagaacccccccattgcttctggcattcatgtgcaattgggagttcacaaagaatcatctaggaggctttgaaaacctacagatgcttggaccccttctctactcacagaatcaaaattcccgggctgtggcccacaaacagggcggttcaagaaactccacaggtgatgctgactcaaactcctggcctatgggggcaataatccagaatgtcagtctcttcttcatttacactgtcgattctggaggtgtctaagccattcccttgcgtaggggtagaggaaagcccaggtgggagaggaggcctgcagtgtctgggagtcttctaaaagcaagtgcctgccacacactggccccagatggggcagcctccggccccagcttcagacccaccatggtttcattgctgcagatgaacttgcctcctaacctctgccctgggctattgaggagcccatgggagcgcttcctagcaccttctctttgcaagtttgagagaagcagctactgggtttccttttgaccatcctctggagataagaggcagagggtagtgcttcctttgcaccttgtggcttgagtgaacaaataaatgatcagcaccagaaacgagcatttagaatgaaatcccaatgttagctgggtgcgggctggcggggataactcccccatcaattctattgattcctttaaggtcaccaacgcttcataaccccaccaagaaggcccaagagaaaaagtcatgtggctgcccattagccagtttaaagcacgaagcaagtgtctgcagaggtgcagttagcttcctgcaagctgcagctccaaattggtgtcgccccagtcatttccgtccctctggagtgtgaagtcagaaaagcgcaggctccgctcgggatcacagagatgaagaaaggagcctgggaggcagcaacgtcttattcagacccaacatggtgtctttccaggtcagaggtagcagagagaaaaagactaagggaataggcttttgtaagcaaacaactgctttcactactccaggccagcccctaagaaccttctttgggagagtggtggccacctccatggcagcaaggctgactgcatttggcattcatgaaaactccaacaatgggggcattcaccctggaaagcctggaaagagaaatactgacattcataaaagaaacagtgggggtgaaatacccgatggacataaatacccatctttaagcctagagttcctgatggtatttcctcaagtgttgagtttacagcagcccttctcagagccttcatgcgctaagatatcacttatgaatctccacaaggatcacagtgtctacggtgtcccaagcttatttggtgagtgagtcccctgccattacatgtcccctgcctgtacaaatgcaggaggaccagctctgatctgttggcccccagaggaggccactcaaagaaccccccactgcttctggcattcattggcaattgggagttcacacagaatcatctagggggcttcgaaaacatccagatgcttggaccccttctctacccacagaatcagaattcctgggctgtggcccacacacagggtggttcaagaaactccacagctgatgctgactcaaactcctggctgggaaacaagggctcctcagataaagtccagatgcttcagaagggcaatgctaaggctttcaataactcattcataatttcacaaaagcctccacgagcagcttcagataccaggaactgctggtgtgggagcagcccctagtctgccttccagcatgaccttttctaaaaccagacgtctagctcccaacagtgtcttgggcattcctgtccatgtgtctctgctcatccctgtcccccatcccaaagctcttctctctccatccacggggatcctgctcatccttccagactggggtgaaatgctacaatctttaatcaagtatctccaagtcccctctctctggtcctcagttcatccctttgaacctcctgtgagcctttccgctttctactctgtattctggaagcattagccaagtagctacagttaatgtgactgaaacagttctgagtcacatatgtttcagaagtatgaatctcagagaggatcaaacagcacacaggttcccaaagttatttggccatgtaaccatttccccatccttctgttattgctgctgttgatttgtttttccctgagcatctcaagggaccctcattgggaaatgctgccttctaattatttccttcattctttcattcaacacgcactccaggaatatcaacaaagtgccaggcatcatgctaggcaccctcacatggtttgtctcaggagctttgctgaaataacttgagaagtgcagctgtagcttatctatggacctatccctccggtgctgtccacagcaggtcccctatcaatcaatattgataagaacttaagccagtgaccagtctggtccgtggggacctataaaaacaactcctgtgacatggcagaatgtaaatcacagcctggcacaggattccaagcatttgggagggcagatggtctccttcaccatggaatcaggaaagaaaaactttaacaggaaatccacacacaggaagaacatggttctgaggacagagtgcatgattaaaaaaaagtgctcagctggttaccggcagaacaaggactctcagatcaccaggctcctcatgataacattatgctgaaaggcacaggattttaattaagaaaaacatagcagaaactgactgctagatggtaatggatggaggaggctgagatgcagaagcatgaagtgggtcctgtggccaggcctgagctatggagaggcatgagctgggtcatgtggagaggcatgagctgggtcctgtggacaggcaaatctgtggctcctgctgaactgtgggaagcacagtggtggggcgggggtgaatgtgctccctgaccaagatgtaaagcacctgccagaagatggacaagcgacaacatgaagcccagagtccccagggcaagtcagttttggcaccagggctggcacatcctctaccattcagcagccagggtgccagaagcagaccctctccaacacaggtagtcacatgtgggctggtggtggcactcaggacacctgaagctcttgccaagtctacgtccatggattggtcaaacacaggccaaaaccctgagtgggaagtagggggcaggggagctttagggaaagcggcaatccatttactccctcccctatcacatagcaggcactgagcacctgctgtgtaccaggacatgagaaaaaacaactgcagtccctgccttcatgaagcgtacagagtaagtgaataaaggacaattattcacacatataaaggaaaattatgatgtgccttggaaggggtaccaccaggtcaggaagatgttcctaagaaatgacacatgagctgatgtctgaagatgaaatgagaattccagtagagggaacgaatgcagagtcctaggaggaaaggagcctggggtatagggagaactgaaaagagaccagtgaggtgggcgtggagggaacagggcatgactggcatgagaagggtttggagggactcagagaccatggaaggactttgtctccataccttaaagcaagaggcagtaacttgatcacatgtgttctgaaaagatcacagcatggacaacagcctggagggcccagggcatgctggagtgtggagtgttaccttgttaatgttaacaaggactctcagatcaacagagatcaagggcaggctggagagagacttgggtggcaaaatcagctgaactccaggatggactgcattgctggaggggaggggaggttacaaggacccaggaggatctcagctcctcaaaaggtgaaccttctctagagcttgggctctgcatggcctcttttggaggggggaaaggctgagcagaagtgtacgtttctcagacacaggaagggctttgttacacgggccccagcctgattccctttctcctctttcgtcagtttatgaacaatttagtgaacccttacaggaaacgggaaagagcacgggatttggaatctggagaactaggtccagcccagccacgggaatctaagtacctggtttaacatcactcacctctccctgtctccccaaccgcctgccagccttggtgtcctgatccctgatcaggacagaggtaagtaacataaccaccccatcagccacctgtgggggccaaatgggaggtcgacgcgagagctccggaaatcataactcatctcctagatttgggtggtggctttgaagactctgagcctgaggccccagccctgcccactcagctggcacctgctatcttttctgggacaggaagagaccacttggcagtcagcatgaagcgctcagtgacaagagtgctcagcttttgattgccctctctttcagtgatcaaaggcaggactctccctttggattttaaacctctggtgcggttacactcatcccagctagaaaacctggcagagggtcaggacaggccaatggttgcagggagttggttctccccttccttttaggctgcagctgtgtctggaagacccatctttttaggggacacctgtgctgttgcagccagcagccgtacttctagtacactctgctaagaaatcagtcagcacctgctgacgccacttattctttaagagagtgtccgtttactgtcagaagtggcagcataatgccatggttaaaaagacagacactggagccttcgcccgggttcaaatgcctttcccttccatctacaagcctcacttgccttactggtaagtggtaccgatgcctcctaaggttacagggatgaaatatgacagtgcacaaaaaacaatcattacctgctatctgtgcatgcgtccacgtctatacatacatgcaggcttgcaagaaagtattcatttattacttcattcaaccagtatcacctacatgctatgcactgttctgtgcattggaaatgaacagatgaactgcagcttcatccctggaaaatgcataatctttggacagatacagacaagcagagagactgccatggtaatgtgttcccaggtgctttgcagggattctgtggaactcagaggaatgcagctaacctagcaccgggtacacaggggcaggtacacagaggggctttggggggcttcctggggaggtgagaaacagtccagcccagaagtgaactgaaggaagaagggcattccagggagaaatagcagcaaacaagagactgcctgatgcattccaggaactgtacagagctggagggagaaggcagatggacatgcggctgcagaagagaccctcgtcatgtccatcaaggcctctcagggcaagagatgccggagacaacttacaatggagcacaaaactgtggagatgatatttaatacactatctgatgatgatactgtacgtatgtctattacagtccctcaacttcttccctccaggtgtagcctctcaaaagcaattctgcaaattctgagcatttgctagattcagcacactaggtgcagtcttgcccacacacggcttaccatgtaggaaaggggaggagaggacacaagaggacgaatgtgaggtgtgtaaaaaacaggctgtccaaaatgcaagatcagggaggagcagagccagagccaggtcttaaaggaaaagttatttggtggcgcagctgagaagtaaaaatgtgccttggctcggccagcccccacatcggggagatactggagtttaacaaacccaagcatttgttcatctgcttcctgcatggtaagatggttatggggctgttgctataagatggggacttccaggctgacctggagcaagactccgggctttccatctctcagctttggataagggttgtaaaacccaattgatggctgactgttggaagcagacctctgcagcccgctttttttaggggaatgttctgaaaatcgaaccacagactcaaatccccatatcaccagcttggttttctcatctatagacaggaataaacagtgatactgaccttacacagcttttgtaaagactaaaccagacaccatatgtgaaagctgagaggagttaagtgatgtggccaaggctgcatgattaagaagcgactgagctggattttaacccaggtggatctgcctcaaagcagacagcccccttctctcctaggagcaggagaagactctaagttccagagaagagggggctggaagggctcttcctggcataatgccagctcttatcagggggcctttgctgtctgcagagcatggcagggggcacagattgatggccaaagaagaaacccatttggaagctcagacaaaacggatgagaaattgcaacatggggttttaggagcaatgtcagttctatgtatacatgcaacgccgttcagcttattgaaacccacaaatgtgtaacacactgcatgtatatagcactgcatttgcagcgtgggttttccaggatgcaaactggatgaagggttttggaatgccagggtgcactgcatggtgcttttggtggaaaagctcgtatagcaaaaacatgtgtctcgcatggagaaataaatcatgtaaacgactgtggccccacttcatgcactggcatgtgtaaaatgtgtttattagcataatagctcatttcactgtattttggctcttaaggaatcttgcagaaacactttcttcttttcctgttgagacatccttttagtccattatgggccaattgcctctgggaattgttaattctaaattaaaatcattaaccatcagaagtgaagcctgtgcgtatacagatcacaatttgtaatcaatatggcctcgcgggtcccagacttgtctacctgactgtgtacttgtcagctcaacggcagctcatccagtgcttgcttaccttgtcattgctctgagcttgcctgttgcaccctagtggaacataagctccagaatataagtcaatttagtcaaggctgtgcttagcaccgagtagggtctcagtaactaccaatggaataaaacaaatgagttaatgagcgactgaatcatgacccaagaatgcttaagccatagcagggctcaagacttggctcagctctgccgctgaccctttcctcacccgtgactcccagcccaggagcggtgggcttctctctgcctctttgctgcatttctgtaaccacctgtgctgcttgttattgtggttctcaaaacactgggctgcctttgctgacttgcagacctggtcctgtgtgggatggtgagttctctgatggcaccattgtatctttttaatctttttattcccagagatgaaagacaagtgattactagtgcagcttttacaatcagagccctagggaaacagggtcatcatcccgaggtggggagcaacctgaaaatactgtagtcgcccatggccaggatgtcctttgaaagccacactctcatgcctgcccaatttattcctaggggtctagttaccaggacactttctatggatggctattaggggagtctcaggcatcactctcctgctactaggggagtcgcaggcaccctccttgcctggggcctgctggaagtgagcctattttattaagcacacgtgcatgaggacgggggcattccaaccaaggcaaccttagaggacacagattggctggccttctcatctaccggtgcattctggaacttaagttttatggatgattccaaattacagcattggtagaaaccatcatggaacatggggccagacataacattacgatattaaatttgtctcttttcagaaatcgcacaagttcttgagattcctcatggactaacaggtacgattaacagacagtcttctgcagcagtgctttcattcttgagacagcactggcagtgaggaactgtgttattacagttttacattcgtggaaaagaagcagggggcagttaatgatcgcagggctggtgaggaacagaacggggggctgagcacaaagcagttcaagcttctctccacaaatctctagcatctctatagaaggcgcacattgttacacagaagtttagtaaacagactttcactgctaggaaatgtctaaataaagcacaggaggactgcatctgccgctgtggaaggctggcccggctgagtgccgcattcctgcacagaggggactgaccatctcccttctgcatcccagcttccctgggaagtagtgcctgaccttgctcctggctgcatgagcccactcatttctaaaatccagcaggacgtcaggggagctgagcaaggagtcgtgtgcattaaggaacctcacacatacctcgcctgatagtcgccgagcagcttctgagactgccaggctacattcagctccttgtcattttcctcgtctttaaaggattgtgccgaagatggaaacaacttgggcggtggtggtggaggggggttctcactctgcatcattgtttgtgcttcaccattttgtcagaaaagttgcacttttttttctttaaaaaatgatagcaagagctttgctgcatcctaaagtgtgactgtgtcattaagactgggttaatatttctttctgcaggaaaacatctctcatctttagtggagacaatgaaaggacaaagtgaatgtaaagaaatgtactttgaaggtggcttttttttcttttgagatgagagtcttgctgtgtcacccaggctggagtgcagtggctcaatcttggctcactgcaacctctggtgagcttgaacccaggatcaagcgattctcctgcctcagcctcccgagtagctgggattacaggcacatgccaccaagcccggctaatttttgtattttagcagatatggggtttcaccacgttggccaggctggtctcaaacttctgacctcaagtgatccacctgccttggcttcccaaagggctgggattacagatgtgattacaccgggcgcggtggctgggattacagccaccgcgcccggctggaggtggctttttaaagaatgctgatatcaggcaaaggaagccaacttcaaaattcctttattgcttccaggtgcttatgggtggcctgaaagaattcaaaaaagctccacagaatattttgcttccttctgaagacatttatgtttattaaatgtcaggtcctatattaaccactgggtccctttaacaaatggtagctactttatttttgtttttattaagcaagtcaggttatttacttctcaggaataagttaagcacctggctggtagaggccagccatgcaagccaatattattctgcctccaccaagtccccaagcaccccagtcctgggtgccaccccttcactcatcacccccatcccaatccccctactgttctgagcagaggcagatgaggccacctttacctctcagctgctggaaacaggaggcactgctgtctggctccagggggtgcctcaggaccccgttgctgggcttgggtctctcgtattctctttcggagagcatggcctgctcgctttccatggcggggtctgagtgcgggggcagggactgtggaaacccaaacatcaagagggaagagaagaagagtaaggcaccgcagagcagaaagccaccccaccaggctccgatccagcgggggtcgtccggagtgatgtccaggttacctgtaaatggaaagagcacagcttagtggagaaaagaaggctggaccactggggattttgctgagaatctgaatccgctgaacagagagggcaagggctctagaaatgacttgcggtcgggaacactggctgccaggctacgaagcctattgttccacaccagcggttctgtttctctcaaagccggaggctgatcacattccctccttaattttcttgtctaccctgtgtttatatcggtctaaacaaaaacagtgagaagccagacgttctctgaatttaggctaaaactggcttggcagcactgctaaggtgtgctgaaagaagcacaaggaaatgtttactgttcagaggtagattttcaccgggtatattcactcttggcttccaaaaagcagctcacacgagatcccactcaatgccccactcactgcctcaatttaggttcacagctcataaggggaggcgcacaatagggttttagagcagggcctctgaagccaggctgcctgggttgaagtcctacccctttgtctctgtgtgaccctaggccagtggtttgaactctctatgcctcagtttactgatctgtataacatctaggatgatggcagtacttagtgggaagatcaaatgaccacaccagacataaaatgctcagaagagtgcctggcgcatgcttgggcacccagatgatggtagcctgttatttatggtgaggggcctttgtttccatgcattaattaattaattaattaatgccaactttgttggtggcctgtggtttggcaccagctctctaatacaaagctttgcagtcaactcatgtgcttaaaggggctatgcatatggtttggtggcactgtaccactatttcttttattgtgccagctaagtcacaagaacataaacttcagcttaccctttggtacagtttttttctttctctctctttacacctgccttgtacagcacagctcccaggtgagctgcttagaaatgtctctttgataataaaccatgcccctggaacatggaaggagaactggggagatctgggcaatggtgtatgaggtaagaccaacagggctgcaggcctggaccagatggatggacagctctgggaagagtaatgaccgcacacaccagatgaacacttcagcactcataaaatgttctccctgaagactcctcagctagcattaatgataaggccagccatcgtttattgagggcttcctctgcaccaggcattatgcagagcacattcttaactgttccagccaaccttccccataactctacaaggcaggacttttattatctgttttctatagatggagtaactgaggcttagaaaggttaggttcgttgcccaggttcatggggctgaagaacggaacacaggtatacacatgccaaggtccacgctctcacctttctgttccactgcccctcttcaatgtctgtttttgggctctctgtagggcccgaggtgaatgatcaattcctgctctttgtgccatgagcctaaggccaccagctcttccagtaggtagcaagtggcctttggaacactggtagtcactgtcctggagatgctgacatacacccagcgcaacaatagcactacaatggaccagatgtttctgcatagctacatgctggagaggggacagtgtaagcctggagtacttggggccgaatcccagctctgccacttactagcatgtgacactgggcagattacttaccctccttgagtcttagctgcatcatttgcaaaataaagacagcttcaacctagagtggttgcaaggatgacaggcaatgagcaagaatcacctgatgcacagtaggctctttgtatagagagagatcttgttattctcacttttatgtacatatatgtatataaatgagaatctcaaaatagggatctttttaaaaaagggtacagcatgggaaaacacaaggtgatcttgaaagcatctttatgcaaatgagggaagacacaaggaagtgaaattgcctctggtagctgaacaggaatattttcactagtcacttactgtgtttcttcacctgctgccaagcaatgaatgaaaacaaaagacagcaaaagggagctgaagtattttcctccattgtctccaggctccataaagggggaattgaaaagctggcagatgtgagcgggtaaagagagagaaatcctagcagttgtttgggggaacaaaattagaaaagtcatattttagttaggaagttagtgactctgttgttctaagtgtgagaaaacaacccagggagagggatggcgatgggggaggtggtggtttgtgtgaacgtgtcaacttgcttcctgtaggtatgtgtatgtctggggaaagctgacgctggctcacagtttgaaagatggggaagggcacgtcacctgtgtcagaaccaaagcccgcctgccacccgggcaagtacaggagacggggcctgcgtgaaggtggtggacagcaggattctgtagatccaagacactcatcactgactattttgggaagtattgatttttttctccatttcaattatccggagcactgtggcagagagaaataacatgctgagagaaactgctcagctgtggagtgtgctgccctgagggcgggggaggctttggtgagtttgatctggggaagacggctactggttggacccgtctgagaaatgtcttgcctctgtccatctctataacaaatactaatttttttttttcttttgaggtggatctcgctctgtcggccaggctggagtgcagtggtgtgatcttggcttactgcaacctccacctcctgggttcaagcgattctcctgccttagcctctcaagtagctgagattacaggtgcccaccaccatgcccggctaatttttgtacttttggtagagatggggtttcaccatgttggccaggctggtcttgaactcctgacctcaggtgatccacccgcgttggcctcccaaagtgctgagattacaggtgtgaaccactgtgcccagctaacaaatataatttttatgaggtattttggctagttttggtgaaaaatctccctccacctgttggtaattgtccgtcaatgctctacagacactgtttcagaactagggatattgagggagagttctctgtgtggctggaagaggacggtgtggtagatgttatcagtgtctgcattggatcctcttcctctgaggacaaggaggatgacacctcctcactctgtgaagttaggtgtaactacaagccacagagctctgcctgtgaaatgtgagcaaggggaaatatatcacttctgtgtggaagtgtgtatgagctggtacatgactccaccccctctttcctcctaagatggtatctgacaggctacaataaatgaaatgtccctgttgacctacactggatgtagcacaaagaagaaagaaccctttagtattctaagctgctgagagttgggagctgtttgttaccgcaacataacctagcctaccctgactagtacaaaaggtttaggaaatagaaatccacgttctataagaacagcagtctcaggcaggcttggcatagcaaaagtattgttttagataaaagtagggaggaaggcttgaaaacctctttacttctctatttggttctagttagtgtcttaactttaaaaaaaatggctgcagtttcagccttctggcaagggctgctttcagtaagatgcccagaacaaaactgaaagcaccaatctgtctcatttacttagatgcattcaattgccaacaaaactagacacatggatgaagaaagatgttgaataaaatgaggtagagacagtatcccaggctgagggaacaggctgagtcaaggtgtggcacattctggggactctaagtaaataggctcaactccctcatcaagccactaatctaccccgtggtcattccagatgatgagaacagatgccatttcattcggagggaagtctggtaaaggggacaggagaaaagggttgcagagtagagcaaagagccatacactgggtgtaccatgaaatatcatgaagccaggcacagcttggacttgtcttgacataggtgtcaacaggcatagaaggtgtttctccttttctagatccattttccgtttttttgttttttgtttttttttttgagatggagtttcactctattgcccaggctgtagtgcagtggtgagatctcagctcactgcaacctccacctcctgggttcaagcaattctcctgcgtcagcctcccaagtagctgagattacaggtgcctaccaacacgcccggctaatttttttttgtatttttagtagagacagggtttcaccatattggctggtctgatctcaaactcctgacctcaggtgatccacctgcctcggcctcccaaaatgctgggattacaggtgagagccactatgcctggccttacaagatcaatttttctaacccttccactctttgtatctgacttctgggttgttcttatttgttgcttgtgttgggtgaattgagagctgttgacagctgtttgctctctctgtcaaaggttaactgaactaggaggctcatggagatttccacccatttccaagatcaaatgaaaagtcactggaaatacagttaaaccagtttaaaactaaccaaccaacccacccacacgctcatgaggatacttgagattgtgagaagaggagatcaaagcaagttggggacatttacttctttttcctgtgccatatggactttttttttttgtagttcatttacccatttgtttaacctatgttgccaaacttttgctatgggactcaagaattccaagagtatcattaagttacaaacctaattagaaactggagacaggaagggactaaggctggagggtggcattgaacatctagaatcgcagccattgggctaattagcccaaaatgaaggaatctagcagtagcagccagccctcaggatggcagagcaggaggctctcagtctgttgaccttttttgtgaagcaaacagatggccacatcttgttccagctgcaaacgccatgcagccttctgcgaggccggctggtgtgtgcctcaggacaagtctgcatggatgtgctggtgaggctaggccatctcagcaaggcctttgtccatggaagggagccgccttctggctaaattcctggagatgtttcagggaagccagctgttctgttaagagtggggctttgaggtcagacaggcctggggatgaatccctgctctatccctagctgtggaaactgttaacctctctcggatttcttattataagtatttattgtgtgcttactatatgccaggcactgtgctaaatgctttgcatgagtaactcatgccatccacacacagactcaggatgtgtgtgcgatgtccccaggatcacagaactcataagggggtgtagtcaggattcaaatggagtctgattccagtgcttgaattcttaaccactgcatgataatgcctcacctaacaataggatctacactcccatgagaatgtgctgaggctccaatgaggcaatctatgtatagctttaagaagtgaccaattcatggctgctgttactactaatctttttgtaataaacccacatagttaaggttggccaaggcagtgattagatatgtactctgctactaagtccgttttttcaaggtcctgttctcacctgggtttcagttaacaaagaacctaaaaaagaaattctggaggcaccatcatttcctcccccagctctcaggggagggatttattctccctgagctgaggagcaaagggaaccacgtagcgatcaaacatggatgaaaggcagcagcggaagcagcccatgtccaagtggagccagctgggacctccaggcaaggtgccccgtgggggctgtcaccccagaactggcccatgtctacaaccagccctccttggcaccccagctgcatctactcacaagtttcaaccaggcttcctcaatggattctcctctcaatgctggcaccaggctatgtggtggacgccgccttctctcctccatctaccccataacgagggccctctgtggacctgccttgctccttccccacaaattttaggctgctgcttttcctggaccccaatctcagtggggacttcagaaacatgtgtccacgtttgtggcccttgcctattaatgcctacagtaatgttcccatacattggacagccctacagaagagcactgttttaggaaagcaaggaaaagataggggaggccctaaagcaattaagaatcccctcctcaaatacagcccaaatccacctgcaggcggcaagtttcacaagactagaaacaataaaaactgctggcaactatagaattctatggctgactccctaaataggataaatgatattcttctgccctctaccggtaaagagctgtgccacacggtgcctcacggtgcctccgggaaggacgcaaacaaagaccgtgactgacaatgcaccttgcattctttggaaacagaaagggaagtccgctatcaacttggtggggaagcctgtcatcagcgagatgcccacacgggactgaaaggagcccacctgccttacatccatgcaggcaccaagtagccaatgagcctggaaccatggatcacaccgctccaccctgggccttaacgggcaaacagagatgccgaacacagtaagatgggaagagcattccaggctgaaggaacagtctcagcaaatggagggaactgggagtggatgggctaagccccctccagccatctgtctacccgctggtcatttcaggcactgagaaaaggtgccgtttcattctcctaagagagtttggtgagtgaaatctccacaggcaggctcaggagatcggggttttatagagatacattccttggattggggacatcccttcccctctctgtgactcggtttcctcatttgtaaaatgaaagagttggaaaggaatgatgtctgaggctctttccagctcagatattctggtcattcgcaggcttttggttcaaggccaccactgatagcactgagggcaaaatatgctatctggccactttgctacccttcaaggtggcttccccattgcatcaggagtaggcctcctctctatcccctctgctggccctgtcttgtgctgccttgggtgcagtggtggaagctggcctgtctatacgagcaagatggaaactgactcacttcatgtgtcctgtgtcttcccagcctacctgttaccacactccctaggaaacgggttcaaagggccagccgacggctgcaaaacaccagcactcaatcaccttcggaacagactcagcactttaaaagtataaataaatagggctgcctctgattttttttttccacttggaaatttgtaacatcattagctacaagtaaatatatcagtaggattaatggagtgaatcacaaagcgacttggatttaaaaccacattatttctttggggtgaattagtaaatttagcattgtcaagagatgatggattgagaacctggggactgagaattcttactgatcctgaggatagatcggcatgagaagcagaggctggaatggcttctcaccctctgttttcagagagaaaggaaatatggctttgctgcatgctaaactacatggaaatatagtgttccttttcagacacaaggtagagatgtgacagcacatggtaggcaatgacccagacggtcccctaaagtccctgctgcctggtattctggtccttgtgtaataatcccttctctttccatagtaaacctgaacaagtgactagcttctaacaaacgaaatacagcagaagtaatgagatgtcacttctgagattaggttataaaaagactgtgactcctgcctcaggtgctctctctcaccttctcttgggttgtttgcttcaggggtgtcacggtgaggtagtcccctccggtgggcccatggcagtgagcttggaagtggatcctccccaagctgagccttgggatgatccaagaccaggttgccaccttgcaacaccttgactgcagcctcataagagaccctgagctagaactgcccagtgaagctgctcctgtattccagacccacagaaaaaaatacgaaaaacagtatgataagaaatgtctgctgttttaggtcattaggtttggggttatttcttatgcagcaacaggaaaccaatacaccacgtgacttgctttggttaatgaaatatgaggggaaacactgtatgtcatttctgagtagaggtttcaagggccagagtaaaactggtttcctgtcttggtaactgtgcaagctggggtcaggatggaacttctgtgggcctgggcctggggggctgagaatgcttatcgatcctgagagtagatctacaggtcaccacgatgagccaagtctccctgaccctgacactgctgacctacactgcatatgtagtgtgaccaagaaataaaccttagttgtataaaatcactgaggttttgggactgtctgtcaccacagaatagtctagcccatcgatctagcatcccattcaatcccacaatcatggattggggaactcagggtattctgagaaatgcacttgcacttcctgctaagaacacaggttctgcttaaaatggttttgaatgtggatatttcctcacaaaggccaccacaacagtgtcttctaaaaggatgttccaatattctgtctcattgaccccgttcgtacacttgcacctccagaacacatgctccaacttttagtttggaaagtaggatcctcatataggttaatgggcccccactcaatgaggatatgccaagcatttctacacagacactctcattaaattcttatctgccaggccgatgtaattattgttaccctttatttacagataaggaaaatacagatttgaggagtaaaatcagctattgggggttattcagcctctaggtagatgttggcagaacccagacttgagtcaggccctctgaaccaacactcacgttctttcatctaatctcgggtgagccccagctacagaggcaggggcatcaagactgtctcttagcaagaaggttttagaacccacaggctgaagccgcatttatgagggaggaaacgcttgcggatggaaggtagacatggagatatattccttacttgtgtcaatgaagaccgcatccacgtagattttggtacagaaagagcccaggataaacccgcaggctggtccaaataccagcatcgtgaacaggattcctgaaggaagatgaagaaaaaaatagattacaaaacagaagctattcgatgagcaaaatcaccaaaggtcaaggagattattttacattgatgagatgagatgacattaggaattcatctaaaaatcctagaggggaaaggctgaatttctaatttttggaaactctatgaaagcactgtatattatgctacaattctatagtatttcaggtaggttgctttgaaatttgtgtcccttacttttagaggacttcaccccacatcaaacatattaaaatacatccgcatctatcattaaatattttttctgccatccacacttttgaaaaggcttttataattttgcttttacatttacttacttttatgtaacttatttaatttatggttggctaagatcccttgacacccactgtgcaaactcaagaattttttgtgaagtgaggataatctatgccacaaattattttcaaatataataaaacgttcaagactccgaaattcagcaaataacaaagttcacacgatggtaaatatctaacatttaattacacatttattaatttcaattcttcaatttctgtccacgttttgaagtcattatctgtttccactgttgttgtggctgcttgtaacagctgttcaggaattaagtgattctgtagcacttgagaaaatggcaggctctgggcagtgcttaagtatctgatcgatacaatacctggtattttacacagaaattttaggacattctgggaaaagtactgatcccaaattcaaacccacaggctgtatctatttaaatttcaatttggtagacatttcttgagcactgacagttctccaggccctggaggcaaaaataagagtccagaaagtggcccttccctttagaagctggccatctgatgaggacagtcagtgcatgggtaattccaggccaggcagctccaaggttgggtgctaacaggccacacgggcacctggagagcagggtgagagatgaatgtcacttgctgggaacctaagcccagtggagggtagctctccagcctagtctgttcataggcgtagaccaactcaccctgaattctctcggtgatgtcattgtggaaccaatcacatattcatccattcagtcaagttttactgagctccttctatgtgccaagtactattctcagggttggggattcagcattgaaccaaccagtaaaaatcctagcctcgctgacttgaagctttccctcctccgaactcattcattgacttgaggtggggaaaaacaacttaaactacacagaggaaggcaaatggtttttaaataccgggcaaaggaagccgcgtaatatagtttgcatgtttgtcccctccaaatctcatgttgaagtgtaatccataatattggaggtggggcctagtgggaggtattagatcatgggggcagaccccttatgaatggctcagcaccgcccccttggtgatgggtgtgctctcactcagttcacacaagatctgattgtttaaaggaatctgggacctccccttctccctcttgctctggctctcgccacgtaatgtgcctgctccccctttgcctcctgccatgattggaagcttctggagaccttcaccaggagcagatgccaacaccatgcttccggtactgtctgcaaaaccccgagccactcgaatctcctttctttgtaaattacccagcctcaggtatttctttatagcaaggcaagaatgaactaacacacatttacacacgggaacccagaaccctgaagcagtcatttgaacggggcttataggagatgtctgatgaaggaaagaatgaagaaaatgttttatatcacagaaacagggctgagtccaccctcagcaaaatcctacttggatgcgaagaaatctggaagttccactgtttccaaatagtcactccatggccaaccagaaactgtagaatcttatttctgttaataagctgcattttagaaaatgaaaatgtgtcactttggagaggagtgacgttcacatgatcagcacattatctctggtttgtcataactttaagataaccaagcacacaaagttgggggcaggggatgttactggaaaagatctttcggaatgggctagaattagggggctctatttagtggggttgtggttagggagcagagcagcaggaagaggatctgagaaagcagcaggaagtagagggcatggagaacagttgtccgagtcagaagcggcacccacactagaccagagagattcctgcaaagtcctgaagccagtcatatcctcccatccaggctgcaggctgtggtaagccagcagtcagagttactggcactctagagacggctcagcaaacaaactcactgctcaggccttcccaaaagaacgggacacagagcacagggatacaattctcttgccatgggtgctgtgcctacccttcttgactcatctgctgtgactcccggcacctcccccatcacccataatcatagcccttcttcccttaaataaatcccccaagcaatgtattcgtcactgatccatgccctacagactgaataatgagaattattattaatacttaatgggtcaaaggaccaagccttcagcatccttggaaaaacagaaacaaccaacaagctgaaggggttgcatcgagactgtgctgttacccccatgcttggggacagtacagttgaaagtgaggactagccagacatcatagcacaattggggtcccaggcctcctgccctcttgcagaaaaggaggggcgtccctcaagctgctggcctcagctgtccacaggagccccacagggcccagatgggccagtgactggggatggtggcttgaacagggaacagcagtggcctgctgtggagacaccacaccctgaggcagcctctccatcaaattcctctatgagaaggtgtgggtttccagagtttggattgtggctttttcaaggtcctgttctcatctgggtttcagctgaacaaagataagctaaaaaggaacaggacggagttgataggaccccacgccaaacaccaaagacattgtgcacacgtattttggtataaaaggcatcttcctcctcaggtgcaacctctggtcacttttctatgtcgctcctcgtcacacggacctcaaggtaaaccaccacctgcaacgcgttctcgaacctttttcaaaggacagtccggtggtgggacgtgggaggggccttcgtgcatcgggaagtgccttcagaaatatcttaacaactgaaacgagcagcttcagaaggcccagatgtgcaaggcaggttctgagctaacaacggttatgctgagctttcttccttggtttcccccttaattcatcctgccaggctgtgattttgttcttgttttggcaaagccagctcgaatgttctgcctgaatggaggaggagcagattgccaggtactgagatgcaggatccctgtggaaggaagggccagcgcctccaggtgcagaaccttctgcagcggcccggtgctgccccctgctgtcttccaggttcatgtatgtcggtggggaggagagcctgggattccctagtcagggaggtctgaaggctttctttgctactaccctggataattgaaagcactttacatgcct

SEQ ID NO: 119 - protein, 25 aa, Artificial Sequence
  Consensus sequence
  VARIANT (2)...(9): Xaa = Any amino acid
  VARIANT (11)...(16): Xaa = Any amino acid
  VARIANT (18)...(20): Xaa = Any amino acid
  VARIANT (22)...(24): Xaa = Any amino acid
  VARIANT (1)...(25): Xaa = Any Amino Acid
CXXXXXXXXCXXXXXXYXXXCXXXC

What is claimed is:

1. An isolated polypeptide selected from the group consisting of:
   a) a polypeptide which is encoded by a nucleic acid comprising the nucleotide sequence of SEQ ID NO:46 or SEQ ID NO:48; and
   b) a polypeptide comprising the amino acid sequence of SEQ ID NO:47.

2. The polypeptide of claim 1, wherein the polypeptide is encoded by a nucleic acid comprising the nucleotide sequence of SEQ ID NO:46 or SEQ ID NO:48.

3. The polypeptide of claim 1, wherein the polypeptide comprises the amino acid sequence of SEQ ID NO:47.

4. The polypeptide of claim 1, wherein the polypeptide is encoded by a nucleic acid consisting of the nucleotide sequence of SEQ ID NO:46 or SEQ ID NO:48.

5. The polypeptide of claim 1, wherein the polypeptide consists of the amino acid sequence of SEQ ID NO:47.

6. An isolated polypeptide comprising the amino acid sequence of SEQ ID NO:47.

7. An isolated polypeptide which is encoded by a nucleic acid molecule comprising the nucleotide sequence of SEQ ID NO:46 or SEQ ID NO:48.

8. The polypeptide of claim 1, further comprising heterologous amino acid sequences.

9. The polypeptide of claim 2, further comprising heterologous amino acid sequences.

10. The polypeptide of claim 3, further comprising heterologous amino acid sequences.

11. The polypeptide of claim 4, further comprising heterologous amino acid sequences.

12. The polypeptide of claim 5, further comprising heterologous amino acid sequences.

13. The polypeptide of claim 6, further comprising heterologous amino acid sequences.

14. The polypeptide of claim 7, further comprising heterologous amino acid sequences.

* * * * *